US007943819B2

(12) United States Patent
Baum et al.

(10) Patent No.: US 7,943,819 B2
(45) Date of Patent: May 17, 2011

(54) METHODS FOR GENETIC CONTROL OF INSECT INFESTATIONS IN PLANTS AND COMPOSITIONS THEREOF

(75) Inventors: James A. Baum, Webster Groves, MO (US); Claire A. Cajacob, Chesterfield, MO (US); Pascale Feldmann, Ghent (BE); Gregory R. Heck, Crystal Lake Park, MO (US); Irene Nooren, Oegstgeest (NL); Geert Plaetinck, Merelbeke (BE); Wendy Maddelein, Gijzenzele (BE); Ty T. Vaughn, Imperial, MO (US)

(73) Assignee: Monsanto Technology LLC, St. Louis, MO (US)

( * ) Notice: Subject to any disclaimer, the term of this patent is extended or adjusted under 35 U.S.C. 154(b) by 645 days.

(21) Appl. No.: 11/522,307

(22) Filed: Sep. 15, 2006

(65) Prior Publication Data
US 2007/0124836 A1    May 31, 2007

Related U.S. Application Data

(60) Provisional application No. 60/718,034, filed on Sep. 16, 2005.

(51) Int. Cl.
*C12N 15/82*    (2006.01)
*C12N 15/87*    (2006.01)
*A01H 1/00*    (2006.01)

(52) U.S. Cl. ......... 800/285; 800/286; 800/288; 800/278
(58) Field of Classification Search ........................ None
See application file for complete search history.

(56) References Cited

U.S. PATENT DOCUMENTS

| | | | | |
|---|---|---|---|---|
| 4,948,734 | A | 8/1990 | Edwards et al. | 435/252.5 |
| 5,107,065 | A | 4/1992 | Shewmaker et al. | 800/298 |
| 5,231,020 | A | 7/1993 | Jorgensen et al. | 800/281 |
| 5,283,184 | A | 2/1994 | Jorgensen et al. | 800/285 |
| 5,629,469 | A | 5/1997 | Deluca-Flaherty et al. | 800/205 |
| 5,759,829 | A | 6/1998 | Shewmaker et al. | 800/286 |
| 6,326,193 | B1 | 12/2001 | Liu et al. | 435/320.1 |
| 6,506,559 | B1 | 1/2003 | Fire et al. | 435/6 |
| 7,109,393 | B2 | 9/2006 | Gutterson | 800/286 |
| 7,348,410 | B2 | 3/2008 | Gaines et al. | 530/350 |
| 7,612,194 | B2 | 11/2009 | Andersen et al. | 800/278 |
| 2002/0048814 | A1 | 4/2002 | Oeller | 435/455 |
| 2003/0018993 | A1 | 1/2003 | Gutterson | 800/286 |
| 2003/0061626 | A1 | 3/2003 | Plaetinck et al. | 800/8 |
| 2003/0150017 | A1 | 8/2003 | Mesa et al. | 800/279 |
| 2003/0175965 | A1 | 9/2003 | Lowe et al. | 435/455 |
| 2004/0029283 | A1 | 2/2004 | Fillatti | 435/468 |
| 2006/0021087 | A1* | 1/2006 | Baum et al. | 800/279 |
| 2006/0174380 | A1 | 8/2006 | Carrington et al. | 800/285 |
| 2007/0050860 | A1 | 3/2007 | Andersen et al. | 800/278 |
| 2007/0061918 | A1 | 3/2007 | Baltz et al. | 800/279 |
| 2010/0192265 | A1 | 7/2010 | Andersen et al. | 800/298 |

FOREIGN PATENT DOCUMENTS

| | | |
|---|---|---|
| WO | WO 94/01550 | 1/1994 |
| WO | WO 2007/083193 | 7/1997 |
| WO | WO 98/05770 | 2/1998 |
| WO | WO 99/49029 | 9/1999 |
| WO | WO 99/53050 | 10/1999 |
| WO | WO 01/09301 | 2/2001 |
| WO | WO 01/34815 | 5/2001 |
| WO | WO 01/37654 | 5/2001 |
| WO | WO 02/46432 | 6/2002 |
| WO | WO 03/004644 | 1/2003 |
| WO | WO 2004/013169 | 2/2004 |
| WO | WO 2004/022771 | 3/2004 |
| WO | WO 2005/019408 | 3/2005 |
| WO | WO 2005/049841 | 6/2005 |
| WO | WO 2005/071091 | 8/2005 |
| WO | WO 2005/110068 | 11/2005 |
| WO | WO 2006/045590 | 5/2006 |

OTHER PUBLICATIONS

GenBank Accession No. AM048926, dated Jul. 16, 2005.
GenPept Accession No. Q4GXU7, dated Nov. 28, 2006.
Lamberton et al., "Varying the nucleic acid composition of siRNA molecules dramatically varies the duration and degree of gene silencing," *Molecular Biotechnology*, 24:111-119, 2003.
Soares et al., "Capillary feeding of specific dsRNA induces silencing of the isac gene in nymphal ixodes scapularis ticks," *Insect Mol. Biol.*, 14(4):443-452, 2005.
Dalmay et al., "An RNA-dependent RNA polymerase gene in *Arabidopsis* is required for posttranscriptional gene silencing mediated by a transgene but not by a virus," *Cell*, 101:543-553, 2000.
Database EMBL, "*Drosophila melanogaster* RE24065 full length cDNA," Database accession No. AY071192, 2001.
Dow et al., "Molecular genetic analysis of V-ATPase function in *Drosophila melanogaster*," *J. Exp. Biol.*, 200(Pt. 2):237-245, 1997.
Dow, "The multifunctional *Drosophila melanogaster* V-ATPase is encoded by a multigene family," *J. Bioenerg. Biomembr.*, 31(1):75-83, 1999.
Elbashir et al., "Analysis of gene function in somatic mammalian cells using small interfering RNAs," *Methods*, 26(2):199-213, 2002.
Elbashir et al., "RNA interference is mediated by 21- and 22-nucleotide RNAs," *Genes Dev.*, 15:188-200, 2001.
Hamilton et al., "A species of small antisense RNA in post-transcriptional gene silencing in plants," *Science*, 286(5441):950-952, 1999.
Kennerdell et al., "Heritable gene silencing in *Drosophila* using double-stranded RNA," *Nat. Biotechnol.*, 18:896-898, 2000.
Kennerdell et al., "Use of dsRNA-mediated genetic interference to demonstrate that frizzled and frizzled 2 act in the wingless pathway," *Cell*, 95:1017-1026, 1998.

(Continued)

*Primary Examiner* — Li Zheng
(74) *Attorney, Agent, or Firm* — Timothy K. Ball, Esq.; SNR Denton US LLP

(57) ABSTRACT

The present invention relates to control of pest infestation by inhibiting one or more biological functions. The invention provides methods and compositions for such control. By feeding one or more recombinant double stranded RNA molecules provided by the invention to the pest, a reduction in pest infestation is obtained through suppression of gene expression. The invention is also directed to methods for making transgenic plants that express the double stranded RNA molecules, and to particular combinations of transgenic pesticidal agents for use in protecting plants from pest infestation.

11 Claims, 7 Drawing Sheets

OTHER PUBLICATIONS

Mourrain et al., "*Arabidopsis* SGS2 and SGS3 genes are required for posttranscriptional gene silencing and natural virus resistance," *Cell*, 101:533, 2000.

Peragine et al., "SGS3 and SGS2/SDE1/RDR6 are required for juvenile development and the production of trans-acting siRNAs in *Arabidopsis*," *Genes Dev.*, 18(19):2368-2379, 2004.

Rajagopal et al., "Silencing of midgut aminopeptidase N of *Spodoptera litura* by double-stranded RNA establishes its role as *Bacillus thuringiensis* toxin receptor," *J. Biol. Chem.*, 277:46849-46851, 2002.

Tabara et al., "RNAi in C. elegans: soaking in the genome sequence," *Science*, 282(5388):430-431, 1998.

Tabashnik, "Evaluation of synergism among *Bacillus thuringiensis* toxins," *Appl. Environ. Microbiol.*, 58(10):3343-3346, 1992.

Vazquez et al., "Endogenous trans-acting siRNAs regulate the accumulation of *Arabidopsis* mRNAs," *Mol. Cell*, 16(1):69-79, 2004.

Yadav et al., "Host-generated double stranded RNA induces RNAi in plant-parasitic nematodes and protects the host from infection," *Molec. Biochem. Parasitol.*, 148(2):219-222, 2006.

Beegle et al., "Invitation paper (CP Alexander Fund): history of *Bacillus thuringiensis* Berliner Research and Development," *Can. Entomol.*, 124:587-616, 1992.

Feitelson et al., "*Bacillus thuringiensis*: insects and beyond," *Bio/Technology*, 10:271-275, 1992.

Feitelson, "The *Bacillus thuringiensis* family tree", In: Advanced Engineered Pesticides, Kim Ed., Marcel Dekker, Inc., New York, pp. 63-71, 1993.

GenBank Accession No. AF008922, dated Jun. 17, 1997.

GenBank Accession No. L09234, Jun. 12, 1993.

GenBank Accession No. U29488, dated Jun. 28, 2001.

GenPept Accession No. NP_001682, May 10, 2002.

Gill et al., "Isolation of the V-ATPase A and c subunit cDNAs from mosquito midgut and malpighian tubules," *Archives of Insect Biochemistry and Physiology*, 37:80-90, 1998.

Gill et al., "The mode of action of *Bacillus thuringiensis* endotoxins," *Annu. Rev. Entomol.*, 37:615-636, 1992.

Hofmann et al., "Specificity of B. thuringiensis delta-endotoxins is correlated with the presence of high-affinity binding sites in the brush border membrane of target insect midguts," *Proc. Natl. Acad. Sci. USA*, 85:7844-7848, 1988.

NCBI Accession No. AW671389, dated Jul. 19, 2000.

New England Biolabs Catalog, 1996/1997, p. 111, undated.

Van Rie et al., "Receptors on the brush border membrane of the insect midgut as determinants of the specificity of *Bacillus thuringiensis* delta-endotoxins," *Appl. Environ. Microbiol.*, 56(5):1378-1385, 1990.

Van Rie et al., "Specificity of *Bacillus thuringiensis* δ-endotoxins," *Eur. J. Biochem.*, 186:239-247, 1989.

Preliminary Amendment regarding U.S. Appl. No. 12/606,990, dated Jan. 9, 2010.

Office Action regarding U.S. Appl. No. 12/606,990, dated Jul. 21, 2010.

Notice of Non-Compliant Amendment regarding U.S. Appl. No. 12/606,990, dated Dec. 10, 2010.

Response to Notice of Non-Compliant Amendment regarding U.S. Appl. No. 12/606,990, dated Dec. 10, 2010.

Amendment and Response to Office Action regarding U.S. Appl. No. 12/606,990, dated Nov. 22, 2010.

* cited by examiner

FIG. 1

DV49 (98503) F1 Bioassay

Economic injury threshold

FIG. 7

DV49-DV248 Fragments (F11-F13)

★ Statistically Significant

METHODS FOR GENETIC CONTROL OF INSECT INFESTATIONS IN PLANTS AND COMPOSITIONS THEREOF

PRIORITY CLAIM

This application claims the priority of U.S. Provisional Application Ser. No. 60/718,034, filed Sep. 16, 2005, which application is incorporated herein by reference in its entirety.

The Sequence Listing is submitted on one compact disc (Copy 1), together with a duplicate thereof (Copy 2), each created on Sep. 15, 2006, and each containing one 669 kb file entitled "MNDE002.APP.TXT." The material contained on the compact disc is specifically incorporated herein by reference.

BACKGROUND OF THE INVENTION

1. Field of the Invention

The present invention relates generally to genetic control of pest infestations. More specifically, the present invention relates to recombinant DNA technologies for post-transcriptionally repressing or inhibiting expression of target coding sequences in the cell of a pest to provide a pest-protective effect.

2. Description of Related Art

The environment in which humans live is replete with pest infestation. Pests including insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like are pervasive in the human environment. A multitude of means have been utilized for attempting to control infestations by these pests. Compositions for controlling infestations by microscopic pests such as bacteria, fungi, and viruses have been provided in the form of antibiotic compositions, antiviral compositions, and antifungal compositions. Compositions for controlling infestations by larger pests such as nematodes, flatworm, roundworms, pinworms, heartworms, tapeworms, trypanosomes, schistosomes, and the like have typically been in the form of chemical compositions that can be applied to surfaces on which pests are present or administered to infested animals in the form of pellets, powders, tablets, pastes, or capsules and the like. There is a great need in the art for improvement of these methods and particularly for methods that would benefit the environment relative to the prior techniques.

Commercial crops are often the targets of insect attack. Substantial progress has been made in the last a few decades towards developing more efficient methods and compositions for controlling insect infestations in plants. Chemical pesticides have been very effective in eradicating pest infestations. However, there are several disadvantages to using chemical pesticidal agents. Chemical pesticidal agents are not selective. Applications of chemical pesticides intended to control invertebrate pests, such as coleopteran insects including corn rootworm species that are harmful to various crops and other plants, exert their effects on non-target fauna as well, often effectively sterilizing a field for a period of time over which the pesticidal agents have been applied. Chemical pesticidal agents persist in the environment and generally are slow to be metabolized, if at all. They accumulate in the food chain, and particularly in the higher predator species. Accumulations of these chemical pesticidal agents results in the development of resistance to the agents and in species higher up the evolutionary ladder, can act as mutagens and/or carcinogens to cause irreversible and deleterious genetic modifications.

Thus there has been a particularly long felt need for environmentally friendly methods for controlling or eradicating insect infestation on or in plants, i.e., methods that are selective, environmentally inert, non-persistent, and biodegradable, and that fit well into pest resistance management schemes.

Compositions that include *Bacillus thuringiensis* (Bt) bacteria have been commercially available and used as environmentally safe and acceptable insecticides for more than thirty years. The insecticidal effect of Bt bacteria do not persist in the environment, are highly selective as to the target species affected, exert their effects only upon ingestion by a target pest, and have been shown to be harmless to plants and other non-targeted organisms, including humans. Transgenic plants containing one or more genes encoding insecticidal Bt protein are also available in the art and are remarkably efficient in controlling insect pest infestation. A substantial result of the use of recombinant plants expressing Bt insecticidal proteins is a marked decrease in the amount of chemical pesticidal agents that are applied to the environment to control pest infestation in crop fields in areas in which such transgenic crops are used. The decrease in application of chemical pesticidal agents has resulted in cleaner soils and cleaner waters running off of the soils into the surrounding streams, rivers, ponds and lakes. In addition to these environmental benefits, there has been a noticeable increase in the numbers of beneficial insects in crop fields in which transgenic insect resistant crops are grown because of the decrease in the use of chemical insecticidal agents.

Antisense methods and compositions have been reported in the art and are believed to exert their effects through the synthesis of a single-stranded RNA molecule that in theory hybridizes in vivo to a substantially complementary sense strand RNA molecule. Antisense technology has been difficult to employ in many systems for three principle reasons. First, the antisense sequence expressed in the transformed cell is unstable. Second, the instability of the antisense sequence expressed in the transformed cell concomitantly creates difficulty in delivery of the sequence to a host, cell type, or biological system remote from the transgenic cell. Third, the difficulties encountered with instability and delivery of the antisense sequence create difficulties in attempting to provide a dose within the recombinant cell expressing the antisense sequence that can effectively modulate the level of expression of the target sense nucleotide sequence.

There have been few improvements in technologies for modulating the level of gene expression within a cell, tissue, or organism, and in particular, a lack of developed technologies for delaying, repressing or otherwise reducing the expression of specific genes using recombinant DNA technology. Furthermore, as a consequence of the unpredictability of these approaches, no commercially viable means for modulating the level of expression of a specific gene in a eukaryotic or prokaryotic organism is available.

Double stranded RNA mediated inhibition of specific genes in various pests has been previously demonstrated. dsRNA mediated approaches to genetic control have been tested in the fruit fly *Drosophila melanogaster* (Kennerdell and Carthew, 1998; Kennerdell and Carthew, 2000). Kennerdell and Carthew (1998) describe a method for delivery of dsRNA involved generating transgenic insects that express double stranded RNA molecules or injecting dsRNA solutions into the insect body or within the egg sac prior to or during embryonic development.

Research investigators have previously demonstrated that double stranded RNA mediated gene suppression can be achieved in nematodes either by feeding or by soaking the nematodes in solutions containing double stranded or small interfering RNA molecules and by injection of the dsRNA molecules. Rajagopal et. al. (2002) described failed attempts to suppress an endogenous gene in larvae of the insect pest *Spodoptera litura* by feeding or by soaking neonate larvae in solutions containing dsRNA specific for the target gene, but were successful in suppression after larvae were injected with dsRNA into the hemolymph of $5^{th}$ instar larvae using a microapplicator. Recently, Yadav et al. (2006) reported that host-generated dsRNA produced in a plant can protect such plants from infection by nematodes. Similarly, U.S. Patent App. Pub. No. 2003/0150017 prophetically described a preferred locus for inhibition of the lepidopteran larvae *Helicoverpa armigera* using dsRNA delivered to the larvae by ingestion of a plant transformed to produce the dsRNA. WO 2005/110068 teaches providing, in the diet of corn rootworm (CRW), CRW-specific dsRNA directed to essential CRW genes. The dsRNA is provided in the CRW diet in-vitro and in-planta, with the result that CRW larvae are stunted or killed after feeding on the diet, and this effect was demonstrated for several different genes.

Therefore, there has existed a need for identifying efficacious nucleotide sequences for use in improved methods of modulating gene expression by repressing, delaying or otherwise reducing gene expression within a particular coleopteran pest for the purpose of controlling pest infestation or to introduce novel phenotypic traits.

SUMMARY OF THE INVENTION

In one aspect, the invention provides a method of inhibiting expression of a target gene in a coleopteran pest. In certain embodiments, the method comprises modulating or inhibiting expression of one or more target genes in a coleopteran pest that causes cessation of feeding, growth, development, reproduction and/or infectivity and eventually result in the death of the insect. The method comprises introduction of partial or fully, stabilized double-stranded RNA (dsRNA), including its modified forms such as small interfering RNA (siRNA) sequences, into the cells or into the extracellular environment, such as the midgut, within a coleopteran pest body wherein the dsRNA enters the cells and inhibits expression of at least one or more target genes and wherein the inhibition exerts a deleterious effect upon the coleopteran pest. The methods and associated compositions may be used for limiting or eliminating coleopteran pest infestation in or on any pest host, pest symbiont, or environment in which a pest is present by providing one or more compositions comprising the dsRNA molecules described herein in the diet of the pest. The method will find particular benefit for protecting plants from insect attack. In one embodiment, the pest is defined as comprising a digestive system pH within the range of from about 4.5 to about 9.5, from about 5 to about 9, from about 6 to about 8, and from about pH 7.0.

In another aspect, the present invention provides exemplary nucleic acid compositions that are homologous to at least a portion of one or more native nucleic acid sequences in a target pest. In certain embodiments, the pest is selected from among *Diabrotica* sp. including Western Corn Rootworm (WCR, *Diabrotica virgifera* or *Diabrotica virgifera virgifera*), Southern Corn Rootworm (SCR, *Diabrotica undecimpunctata howardi*), Mexican Corn Rootworm (MCR, *Diabrotica virgifera zea*), Brazilian Corn Rootworm (BZR, *Diabrotica balteata, Diabrotica viridula, Diabrotica speciosa*), Northern Corn rootworm (NCR, *Diabrotica barberi*), *Diabrotica undecimpunctata*; as well as Colorado Potato Beetle (CPB, *Leptinotarsa decemlineata*), Red Flour Beetle (RFB, *Tribolium castaneum*), and Mexican Bean Beetle (*Epilachna varivestis*). In other embodiments the pest is selected from among Lepidopteran insects including European Corn Borer (ECB, *Ostrinia nubilalis*), Black Cutworm (BCW, *Agrotis ipsilon*), Corn Earworm (CEW, *Helicoverpa zea*), Fall Armyworm (FAW, *Spodoptera frugiperda*), Cotton Ball Weevil (BWV, *Anthonomus grandis*), silkworms (*Bombyx mori*) and *Manduca sexta*, and from Dipteran insects including *Drosophila melanogaster, Anopheles gambiae*, and *Aedes aegypti*. Specific examples of such nucleic acids provided by the invention are given in the attached sequence listing as SEQ ID NO:1 through SEQ ID NO:906.

In yet another aspect, the invention provides a method for suppression of gene expression in a coleopteran pest such as a corn rootworm or related species that comprises the step of providing in the diet of the pest a gene suppressive amount of at least one dsRNA molecule transcribed from a nucleotide sequence as described herein, at least one segment of which is complementary to an mRNA sequence within the cells of the pest. The method may further comprise observing the death, inhibition, stunting, or cessation of feeding of the pest. A dsRNA molecule, including its modified form such as an siRNA molecule, fed to a pest in accordance with the invention may be at least from about 80, 81, 82, 83, 84, 85, 86, 87, 88 89, 90, 91, 92, 93, 94, 95, 96, 97, 98, 99, or about 100% identical to a RNA molecule transcribed from a nucleotide sequence selected from the group consisting of SEQ ID NO:1 through SEQ ID NO:906. In particular embodiments, the nucleotide sequence may be selected from the group consisting of SEQ ID NO:697, SEQ ID NOs:813-819, SEQ ID NO:841, and SEQ ID NO:874.

Accordingly, in another aspect of the present invention, a set of isolated and purified nucleotide sequences as set forth in SEQ ID NO:1 through SEQ ID NO:906 is provided. The present invention provides a stabilized dsRNA molecule or the expression of one or more miRNAs for inhibition of expression of a target gene in a coleopteran pest expressed from these sequences and fragments thereof. A stabilized dsRNA, including a miRNA or siRNA molecule can comprise at least two coding sequences that are arranged in a sense and an antisense orientation relative to at least one promoter, wherein the nucleotide sequence that comprises a sense strand and an antisense strand are linked or connected by a spacer sequence of at least from about five to about one thousand nucleotides, wherein the sense strand and the antisense strand may be a different length, and wherein each of the two coding sequences shares at least 80% sequence identity, at least 90%, at least 95%, at least 98%, or 100% sequence identity, to any one or more nucleotide sequence(s) set forth in set forth in SEQ ID NO: 1 through SEQ ID NO:906.

Further provided by the invention is a fragment or concatemer of a nucleic acid sequence selected from the group consisting of SEQ ID NO:1 through SEQ ID NO:906. In particular embodiments, the nucleotide sequence may comprise a fragment or concatemer of a sequence selected from the group consisting of SEQ ID NO:697, SEQ ID NOs:813-819, SEQ ID NO:841, and SEQ ID NO:874.

The fragment may be defined as causing a the death, inhibition, stunting, or cessation of feeding of a pest when expressed as a dsRNA and provided to the pest. The fragment may, for example, comprise at least about 19, 21, 23, 25, 40, 60, 80, 100, 125 or more contiguous nucleotides of any one or more of the sequences in SEQ ID NO:1 through SEQ ID NO:906, or a complement thereof. One beneficial DNA segment for use in the present invention is at least from about 19 to about 23, or about 23 to about 100 nucleotides up to about 2000 nucleotides or more in length. Particularly useful will be dsRNA sequences including about 23 to about 300 nucleotides homologous to a pest target sequence. The invention also provides a ribonucleic acid expressed from any of such sequences including a dsRNA. A sequence selected for use in expression of a gene suppression agent can be constructed from a single sequence derived from one or more target pests and intended for use in expression of an RNA that functions in the suppression of a single gene or gene family in the one or more target pests, or that the DNA sequence can be constructed as a chimera from a plurality of DNA sequences.

In yet another aspect, the invention provides recombinant DNA constructs comprising a nucleic acid molecule encoding a dsRNA molecule described herein. The dsRNA may be formed by transcription of one strand of the dsRNA molecule from a nucleotide sequence which is at least from about 80% to about 100% identical to a nucleotide sequence selected from the group consisting of SEQ ID NO:1 through SEQ ID NO:906. Such recombinant DNA constructs may be defined as producing dsRNA molecules capable of inhibiting the expression of endogenous target gene(s) in a pest cell upon ingestion. The construct may comprise a nucleotide sequence of the invention operably linked to a promoter sequence that functions in the host cell. Such a promoter may be tissue-specific and may, for example, be specific to a tissue type which is the subject of pest attack. In the case of rootworms, for example, it may be desired to use a promoter providing root-preferred expression.

Nucleic acid constructs in accordance with the invention may comprise at least one non-naturally occurring nucleotide sequence that can be transcribed into a single stranded RNA capable of forming a dsRNA molecule in vivo through hybridization. Such dsRNA sequences self assemble and can be provided in the diet of a coleopteran pest to achieve the desired inhibition.

A recombinant DNA construct may comprise two different non-naturally occurring sequences which, when expressed in vivo as dsRNA sequences and provided in the diet of a coleopteran pest, inhibit the expression of at least two different target genes in the cell of the coleopteran pest. In certain embodiments, at least 3, 4, 5, 6, 8 or 10 or more different dsRNAs are produced in a cell or plant comprising the cell that have a pest-inhibitory effect. The dsRNAs may expressed from multiple constructs introduced in different transformation events or could be introduced on a single nucleic acid molecule. The dsRNAs may be expressed using a single promoter or multiple promoters. In one embodiments of the invention, single dsRNAs are produced that comprise nucleic acids homologous to multiple loci within a pest.

In still yet another aspect, the invention provides a recombinant host cell having in its genome at least one recombinant DNA sequence that is transcribed to produce at least one dsRNA molecule that functions when ingested by a coleopteran pest to inhibit the expression of a target gene in the pest. The dsRNA molecule may be encoded by any of the nucleic acids described herein and as set forth in the sequence listing. The present invention also provides a transformed plant cell having in its genome at least one recombinant DNA sequence described herein. Transgenic plants comprising such a transformed plant cell are also provided, including progeny plants of any generation, seeds, and plant products, each comprising the recombinant DNA.

The methods and compositions of the present invention may be applied to any monocot and dicot plant, depending on the coleopteran pest control desired. Specifically, the plants are intended to include, without limitation, alfalfa, aneth, apple, apricot, artichoke, arugula, asparagus, avocado, banana, barley, beans, beet, blackberry, blueberry, broccoli, brussel sprouts, cabbage, canola, cantaloupe, carrot, cassava, cauliflower, celery, cherry, cilantro, citrus, clementine, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, Southern pine, soybean, spinach, squash, strawberry, sugarbeet, sugarcane, sunflower, sweet potato, sweetgum, tangerine, tea, tobacco, tomato, turf, a vine, watermelon, wheat, yams, and zucchini plants. Thus, a plant transformed with a recombinant DNA sequence as set forth in SEQ ID NO: 1 through SEQ ID NO:906, or concatemer, fragment, or complement thereof, that is transcribed to produce at least one dsRNA molecule that functions when ingested by a coleopteran pest to inhibit the expression of a target gene in the pest is also provided by the invention. In particular embodiments, the recombinant DNA sequence may be selected from the group consisting of SEQ ID NO:697, SEQ ID NOs:813-819, SEQ ID NO:841, and SEQ ID NO:874, or fragment, complement, or concatemer thereof.

The invention also provides combinations of methods and compositions for controlling coleopteran pest infestations. One means provides a dsRNA method as described herein for protecting plants from insect infestation along with one or more insecticidal agents that exhibit features different from those exhibited by the dsRNA methods and compositions. For example, one or more Bt proteins may be provided in the diet of insect pests in combination with one or more dsRNAs as described herein. A composition formulated for topical application or derived using a transgenic approach that combines dsRNA methods and compositions with Bt may be used to provide synergies that were not known previously in the art for controlling insect infestation. One synergy is the reduction in the level of expression required for either the dsRNA(s) or the Bt protein(s). When combined together, a lower effective dose of each pest control agent could be used. It is believed that the Bt insecticidal proteins create entry pores through which the dsRNA molecules are able to penetrate more effectively into spaces remote from the gut of the insect pest, or more efficiently into the cells in the proximity of lesions created by the Bt proteins, thus requiring less of either the Bt or the dsRNA to achieve the desired insecticidal result or the desired inhibition or suppression of a targeted biological function in the target pest.

The present invention therefore provides a composition that contains two or more different pesticidal agents each toxic to the same pest or insect species, at least one of which comprises a dsRNA described herein. In certain embodiments, the second agent can be an agent selected from the group consisting of a patatin, a *Bacillus thuringiensis* insecticidal protein, a *Xenorhabdus insecticidal* protein, a *Photorhabdus* insecticidal protein, a *Bacillus laterosporous* insecticidal protein, a *Bacillus sphaericus* insecticidal protein, and a lignin. A *Bacillus thuringiensis* insecticidal protein can be any of a number of insecticidal proteins including but not limited to a Cry1, a Cry3, a TIC851, a CryET70, a Cry22, a TIC901, a TIC1201, a TIC407, a TIC417, a binary insecticidal protein CryET33 and CryET34, a binary insecticidal protein CryET80 and CryET76, a binary insecticidal protein TIC100 and TIC101, a binary insecticidal protein PS149B1, a VIP insecticidal protein, a TIC900 or related protein, or combinations of the insecticidal proteins ET29 or ET37 with insecticidal proteins TIC810 or TIC812, and insecticidal chimeras of any of the preceding insecticidal proteins.

A ribonucleic acid that is provided in a diet can be provided in an artificial diet formulated to meet particular nutritional requirements for maintaining a pest on such diet. The diet may be supplemented with a pest controlling amount of an RNA that has been purified from a separate expression system to determine a pest controlling amount of RNA composition or to determine extent of suppressive activity upon ingestion of the supplemented diet by the pest. The diet can also be a recombinant cell transformed with a DNA sequence constructed for expression of the agent, the RNA, or the gene suppression agent. Upon ingestion of one or more such transformed cells by the pest, a desired phenotypic result is observed, indicating that the agent has functioned to inhibit the expression of a target nucleotide sequence that is within the cells of the pest.

A gene targeted for suppression can encode an essential protein, the predicted function of which is selected from the group consisting of muscle formation, juvenile hormone formation, juvenile hormone regulation, ion regulation and transport, protein synthesis and transport, digestive enzyme synthesis, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, an unknown function, and apoptosis.

Another aspect of the present invention also provides methods for improving the yield of a crop produced from a crop plant subjected to insect pest infestation, said method comprising the steps of a) introducing a polynucleotide comprising a sequence selected from SEQ ID NO:1 through SEQ ID NO:906 or a complement or concatemer or fragment thereof into said crop plant; and b) cultivating the crop plant to allow the expression of said polynucleotide, wherein expression of the polynucleotide inhibits feeding by insect pests and loss of yield due to pest infestation.

In certain embodiments, the expression of the polynucleotide produces an RNA molecule that suppresses at least a first target gene in an insect pest that has ingested a portion of said crop plant, wherein the target gene performs at least one essential function selected from the group consisting of feeding by the pest, viability of the pest, pest cell apoptosis, differentiation and development of the pest or any pest cell, sexual reproduction by the pest, muscle formation, muscle twitching, muscle contraction, juvenile hormone formation and/or reduction, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, egg formation, larval maturation, digestive enzyme formation, haemolymph synthesis, haemolymph maintenance, neurotransmission, larval stage transition, pupation, emergence from pupation, cell division, energy metabolism, respiration, cytoskeletal structure synthesis and maintenance, nucleotide metabolism, nitrogen metabolism, water use, water retention, and sensory perception.

In other embodiments, the insect pest is a corn rootworm pest selected from the group consisting of *Diabrotica undecimpunctata howardi* (Southern Corn Rootworm (SCR)), *Diabrotica virgifera virgifera* (Western Corn Rootworm (WCR)), *Diabrotica barberi* (Northern Corn Rootworm (NCR)), *Diabrotica virgifera zea* (Mexican Corn Rootworm (MCR)), *Diabrotica balteata* (Brazilian Corn Rootworm (BZR)), *Diabrotica viridula* (Brazilian Corn Rootworm (BZR)), and *Diabrotica speciosa* (Brazilian Corn Rootworm (BZR)).

Methods for improving the drought tolerance of a crop produced from a crop plant subjected to insect pest infestation, said method comprising the steps of a) introducing a polynucleotide sequence selected from SEQ ID NO:1 through SEQ ID NO:906, or a fragment thereof, into said crop plant; and b) cultivating the crop plant to allow the expression of said polynucleotide, wherein expression of the polynucleotide inhibits feeding by insects pests and loss of drought tolerance due to pest infestation, are also provided.

Yet another aspect of the invention further provides agronomically and commercially important products and/or compositions of matter including, but not limited to, animal feed, commodities, products and by-products that are intended for use as food for human consumption or for use in compositions and commodities that are intended for human consumption including but not limited to corn flour, corn meal, corn syrup, corn oil, corn starch, popcorn, corn cakes, cereals, and the like. Such compositions may be defined as containing detectable amounts of a nucleotide sequence set forth herein, and thus are also diagnostic for any transgenic event containing such nucleotide sequences. These products are useful at least because they are likely to be derived from crops propagated with fewer pesticides and organophosphates as a result of their incorporation of the nucleotides of the present invention for controlling the infestation of coleopteran pests in plants. Such commodities and commodity products can be produced from seed produced from a transgenic plant, wherein the transgenic plant expresses RNA from one or more contiguous nucleotides of the present invention or nucleotides of one or more coleopteran pests and the complements thereof. Such commodities and commodity products may also be useful in controlling coleopteran pests of such commodity and commodity products, such as for example, control of flour weevils, because of the presence in the commodity or commodity product of the pest gene suppressive RNA expressed from a gene sequence as set forth in the present invention.

A method of producing such a commodity product comprising obtaining a plant transformed with a polynucleotide comprising a sequence selected from the group consisting of SEQ ID NO:1 through SEQ ID NO:906, or a concatemer or fragment or complement thereof, and preparing a commodity product from the plant or part thereof is also provided. Further, a method of producing food or feed, comprising obtaining a plant transformed with a polynucleotide selected from the group consisting of SEQ ID NO:1 through SEQ ID NO:906 or a fragment or complement thereof, and preparing food or feed from said plant or part thereof is yet another aspect of the invention.

The invention also provides a computer readable medium having recorded thereon one or more of the nucleotide sequences as set forth in SEQ ID NO:1 through SEQ ID NO:906, or complements thereof, for use in a number of computer based applications, including but not limited to DNA identity and similarity searching, protein identity and similarity searching, transcription profiling characterizations, comparisons between genomes, and artificial hybridization analyses.

BRIEF DESCRIPTION OF THE FIGURES

FIG. 1: Bioassay of F1 corn plant events transformed with pMON98503 (SEQ ID NO:820) and challenged with Western Corn Rootworm (WCR).

FIG. 7: DV49-DV248 concatemer 38 dose response (Fragments F11-F13).

DETAILED DESCRIPTION OF THE INVENTION

Figure 2:
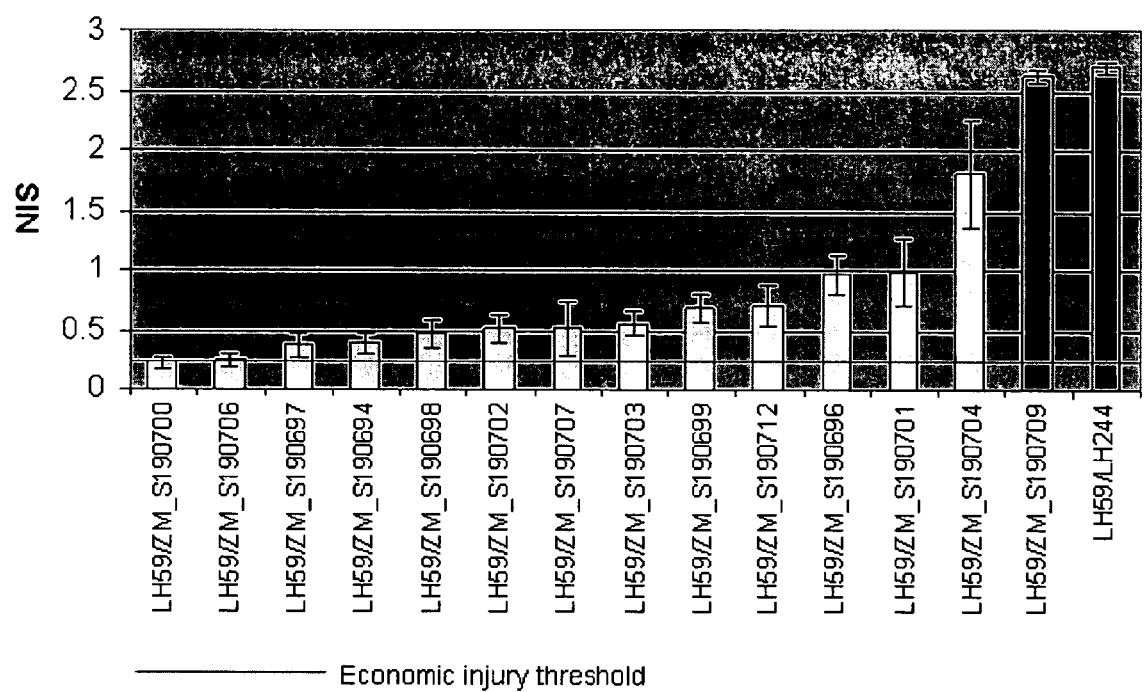
FIG. 2: Bioassay of F1 corn plant events transformed with pMON98504 comprising concatemer C1 (SEQ ID NO:821) and challenged with Western Corn Rootworm (WCR).

The following is a detailed description of the invention provided to aid those skilled in the art in practicing the present invention. Those of ordinary skill in the art may make modifications and variations in the embodiments described herein without departing from the spirit or scope of the present invention.

The present invention provides methods and compositions for genetic control of pest infestations. For example, the present invention provides recombinant DNA technologies to post-transcriptionally repress or inhibit expression of a target coding sequence in the cell of a pest to provide a pest-protective effect by feeding to the pest one or more double stranded or small interfering ribonucleic acid (RNA) molecules transcribed from all or a portion of a target coding sequence, thereby controlling the infestation. Therefore, the present invention relates to sequence-specific inhibition of expression of coding sequences using double-stranded RNA (dsRNA), including small interfering RNA (siRNA), to achieve the intended levels of pest control.

Isolated and substantially purified nucleic acid molecules including but not limited to non-naturally occurring nucleotide sequences and recombinant DNA constructs for transcribing dsRNA molecules of the present invention are provided that suppress or inhibit the expression of an endogenous coding sequence or a target coding sequence in the pest when introduced thereto. Transgenic plants that (a) contain nucleotide sequences encoding the isolated and substantially purified nucleic acid molecules and the non-naturally occurring recombinant DNA constructs for transcribing the dsRNA molecules for controlling plant pest infestations, and (b) display resistance and/or enhanced tolerance to the insect infestations, are also provided. Compositions containing the dsRNA nucleotide sequences of the present invention for use in topical applications onto plants or onto animals or into the environment of an animal to achieve the elimination or reduction of pest infestation are also described.

The inventors have herein discovered that, contrary to the teachings in the prior art, feeding a composition containing double stranded RNA molecules consisting of sequences found within one or more expressed nucleotide sequences of a coleopteran species to the species from which the nucleotide sequences were obtained results in the inhibition of one or more biological functions within the coleopteran species. Particularly, the inventors have discovered that feeding the double stranded RNA molecules described herein to crop pest species such as corn rootworms results in the death or inhibition of development and differentiation of insect pests that ingest these compositions.

The inventors have identified the nucleotide sequences described herein as providing plant protective effects against coleopteran pest species. Amino acid sequences encoded by the cDNA sequences have been deduced and compared to known amino acid sequences. Many of the sequences are predicted to encode proteins that have some annotation information associated with them. The annotation information that is associated with a particular nucleotide sequence and protein sequence encoded therefrom is based on homology or similarity between the amino acid sequences deduced through translation of the coding sequences described herein as set forth and amino acid sequences that are known in the art in publicly available databases.

cDNA sequences encoding proteins or parts of proteins essential for survival, such as amino acid sequences involved in various metabolic or catabolic biochemical pathways, cell division, reproduction, energy metabolism, digestion, neurological function and the like were selected for use in preparing double stranded RNA molecules that were provided in the diet of coleopteran pests. As described herein, ingestion by a target pest of compositions containing one or more dsRNAs, at least one segment of which corresponds to at least a substantially identical segment of RNA produced in the cells of the target pest, resulted in death, stunting, or other inhibition of the target pest. These results indicated that a nucleotide sequence, either DNA or RNA, derived from a coleopteran pest can be used to construct plant cells resistant to infestation by the pest. The pest host, for example, can be transformed to contain one or more of the nucleotide sequences derived from the coleopteran pest. The nucleotide sequence transformed into the pest host or symbiont may encode one or more RNAs that form into a dsRNA sequence in the cells or biological fluids within the transformed host or symbiont, thus making the dsRNA available in the diet of the pest if/when the pest feeds upon the transgenic host or symbiont, resulting in the suppression of expression of one or more genes in the cells of the pest and ultimately the death, stunting, or other inhibition of the pest The present invention relates generally to genetic control of coleopteran pest infestations in host organisms. More particularly, the present invention includes the methods for delivery of pest control agents to a coleopteran pest. Such pest control agents cause, directly or indirectly, an impairment in the ability of the pest to maintain itself, grow or otherwise infest a target host or symbiont. The present invention provides methods for employing stabilized dsRNA molecules in the diet of the pest as a means for suppression of targeted genes in the pest, thus achieving desired control of pest infestations in, or about the host or symbiont targeted by the pest.

In accomplishing the foregoing, the present invention provides a method of inhibiting expression of a target gene in a coleopteran pest, including for example, corn rootworms or other coleopteran insect species, resulting in the cessation of feeding, growth, development, reproduction, infectivity, and eventually may result in the death of the pest. The method comprises in one embodiment introducing partial or fully stabilized double-stranded RNA (dsRNA) nucleotide molecules into a nutritional composition that the pest relies on as a food source, and making the nutritional composition available to the pest for feeding. Ingestion of the nutritional composition containing the double stranded or siRNA molecules results in the uptake of the molecules by the cells of the pest, resulting in the inhibition of expression of at least one target gene in the cells of the pest. Inhibition of the target gene exerts a deleterious effect upon the pest.

In certain embodiments, dsRNA molecules provided by the invention comprise nucleotide sequences complementary to a sequence as set forth in any of SEQ ID NO:1 through SEQ ID NO:906, the inhibition of which in a pest organism results in the reduction or removal of a protein or nucleotide sequence agent that is essential for the pests' growth and development or other biological function. The nucleotide sequence selected may exhibit from about 80% to at least about 100% sequence identity to one of the nucleotide sequences as set forth in SEQ ID NO:1 through SEQ ID NO:906, as set forth in the sequence listing, including the complement thereof. Such inhibition can be described as specific in that a nucleotide sequence from a portion of the target gene is chosen from which the inhibitory dsRNA or siRNA is transcribed. The method is effective in inhibiting the expression of at least one target gene and can be used to inhibit many different types of target genes in the pest. In particular embodiments, the nucleotide sequence may be selected from the group consisting of SEQ ID NO:697, SEQ ID NOs:813-819, SEQ ID NO:841, and SEQ ID NO:874.

The sequences identified as having a pest protective effect may be readily expressed as dsRNA molecules through the creation of appropriate expression constructs. For example, such sequences can be expressed as a hairpin and stem and loop structure by taking a first segment corresponding to a sequence selected from SEQ ID NO:1 through SEQ ID NO:906 or a fragment thereof, linking this sequence to a second segment spacer region that is not homologous or complementary to the first segment, and linking this to a third segment that transcribes an RNA, wherein at least a portion of the third segment is substantially complementary to the first segment. Such a construct forms a stem and loop structure by hybridization of the first segment with the third segment and a loop structure forms comprising the second segment (WO94/01550, WO98/05770, US 2002/0048814A1, and US 2003/0018993A1).

A. Nucleic Acid Compositions and Constructs

The invention provides recombinant DNA constructs for use in achieving stable transformation of particular host or symbiont pest targets. Transformed host or symbiont pest targets may express pesticidally effective levels of preferred dsRNA or siRNA molecules from the recombinant DNA constructs, and provide the molecules in the diet of the pest. Pairs of isolated and purified nucleotide sequences may be provided from cDNA library and/or genomic library information. The pairs of nucleotide sequences may be derived from any preferred coleopteran pest for use as thermal amplification primers to generate DNA templates for the preparation of dsRNA and siRNA molecules of the present invention.

As used herein, the term "nucleic acid" refers to a single or double-stranded polymer of deoxyribonucleotide or ribonucleotide bases read from the 5' to the 3' end. The "nucleic acid" may also optionally contain non-naturally occurring or altered nucleotide bases that permit correct read through by a polymerase and do not reduce expression of a polypeptide encoded by that nucleic acid. The term "nucleotide sequence" or "nucleic acid sequence" refers to both the sense and antisense strands of a nucleic acid as either individual single strands or in the duplex. The term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment", "nucleotide sequence segment", or more generally "segment" will be understood by those in the art as a functional term that includes both genomic sequences, ribosomal RNA sequences, transfer RNA sequences, messenger RNA sequences, operon sequences and smaller engineered nucleotide sequences that express or may be adapted to express, proteins, polypeptides or peptides.

Provided according to the invention are nucleotide sequences, the expression of which results in an RNA sequence which is substantially homologous to an RNA molecule of a targeted gene in an insect that comprises an RNA sequence encoded by a nucleotide sequence within the genome of the insect. Thus, after ingestion of the stabilized RNA sequence down-regulation of the nucleotide sequence of the target gene in the cells of the insect may be obtained resulting in a deleterious effect on the maintenance, viability, proliferation, reproduction and infestation of the insect.

As used herein, the term "substantially homologous" or "substantial homology", with reference to a nucleic acid sequence, includes a nucleotide sequence that hybridizes under stringent conditions to the coding sequence as set forth in any of SEQ ID NO:1 through SEQ ID NO:906 as set forth in the sequence listing, or the complements thereof. Sequences that hybridize under stringent conditions to any of SEQ ID NO:1 through SEQ ID NO:906 as set forth in the sequence listing, or the complements thereof, are those that allow an antiparallel alignment to take place between the two sequences, and the two sequences are then able, under stringent conditions, to form hydrogen bonds with corresponding bases on the opposite strand to form a duplex molecule that is sufficiently stable under the stringent conditions to be detectable using methods well known in the art. Substantially homologous sequences have preferably from about 70% to about 80% sequence identity, or more preferably from about 80% to about 85% sequence identity, or most preferable from about 90% to about 95% sequence identity, to about 99% sequence identity, to the referent nucleotide sequences as set forth in any of SEQ ID NO:1 through SEQ ID NO:906 as set forth in the sequence listing, or the complements thereof.

As used herein, the term "sequence identity", "sequence similarity" or "homology" is used to describe sequence relationships between two or more nucleotide sequences. The percentage of "sequence identity" between two sequences is determined by comparing two optimally aligned sequences over a comparison window, wherein the portion of the sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. A first nucleotide sequence when observed in the 5' to 3' direction is said to be a "complement" of, or complementary to, a second or reference nucleotide sequence observed in the 3' to 5' direction if the first nucleotide sequence exhibits complete complementarity with the second or reference sequence. As used herein, nucleic acid sequence molecules are said to exhibit "complete complementarity" when every nucleotide of one of the sequences read 5' to 3' is complementary to every nucleotide of the other sequence when read 3' to 5'. A nucleotide sequence that is complementary to a reference nucleotide sequence will exhibit a sequence identical to the reverse complement sequence of the reference nucleotide sequence. These terms and descriptions are well defined in the art and are easily understood by those of ordinary skill in the art.

As used herein, a "comparison window" refers to a conceptual segment of at least 6 contiguous positions, usually about 50 to about 100, more usually about 100 to about 150, in which a sequence is compared to a reference sequence of the same number of contiguous positions after the two sequences are optimally aligned. The comparison window may comprise additions or deletions (i.e. gaps) of about 20% or less as compared to the reference sequence (which does not comprise additions or deletions) for optimal alignment of the two sequences Those skilled in the art should refer to the detailed methods used for sequence alignment in the Wisconsin Genetics Software Package Release 7.0, Genetics Computer Group, 575 Science Drive Madison, Wis., USA) or refer to Ausubel et al. (1998) for a detailed discussion of sequence analysis.

The present invention provides DNA sequences capable of being expressed as an RNA in a cell or microorganism to inhibit target gene expression in a cell, tissue or organ of an insect. The sequences comprises a DNA molecule coding for one or more different nucleotide sequences, wherein each of the different nucleotide sequences comprises a sense nucleotide sequence and an antisense nucleotide sequence connected by a spacer sequence coding for a dsRNA molecule of the present invention. The spacer sequence constitutes part of the sense nucleotide sequence or the antisense nucleotide sequence and forms within the dsRNA molecule between the sense and antisense sequences. The sense nucleotide sequence or the antisense nucleotide sequence is substantially identical to the nucleotide sequence of the target gene or a derivative thereof or a complementary sequence thereto. The dsDNA molecule may be placed operably under the control of a promoter sequence that functions in the cell, tissue or organ of the host expressing the dsDNA to produce dsRNA molecules. In one embodiment, the DNA sequence may be derived from a nucleotide sequence as set forth in SEQ ID NO:1 through SEQ ID NO:906 in the sequence listing.

The invention also provides a DNA sequence for expression in a cell of a plant that, upon expression of the DNA to RNA and ingestion by a target pest achieves suppression of a target gene in a cell, tissue or organ of an insect pest. The dsRNA at least comprises one or multiple structural gene sequences, wherein each of the structural gene sequences comprises a sense nucleotide sequence and an antisense nucleotide sequence connected by a spacer sequence that forms a loop within the complementary and antisense sequences. The sense nucleotide sequence or the antisense nucleotide sequence is substantially identical to the nucleotide sequence of the target gene, derivative thereof, or sequence complementary thereto. The one or more structural gene sequences is placed operably under the control of one or more promoter sequences, at least one of which is operable in the cell, tissue or organ of a prokaryotic or eukaryotic organism, particularly a plant.

A gene sequence or fragment for pest control according to the invention may be cloned between two tissue specific promoters, such as two root specific promoters which are operable in a transgenic plant cell and therein expressed to produce mRNA in the transgenic plant cell that form dsRNA molecules thereto. The dsRNA molecules contained in plant tissues are ingested by an insect so that the intended suppression of the target gene expression is achieved.

A nucleotide sequence provided by the present invention may comprise an inverted repeat separated by a "spacer sequence." The spacer sequence may be a region comprising any sequence of nucleotides that facilitates secondary structure formation between each repeat, where this is required. In one embodiment of the present invention, the spacer sequence is part of the sense or antisense coding sequence for mRNA. The spacer sequence may alternatively comprise any combination of nucleotides or homologues thereof that are capable of being linked covalently to a nucleic acid molecule. The spacer sequence may comprise a sequence of nucleotides of at least about 10-100 nucleotides in length, or alternatively at least about 100-200 nucleotides in length, at least 200-400 about nucleotides in length, or at least about 400-500 nucleotides in length.

The nucleic acid molecules or fragment of the nucleic acid molecules or other nucleic acid molecules in the sequence listing are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the complement of another nucleic acid molecule if they exhibit complete complementarity. Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al. (1989), and by Haymes et al. (1985).

Departures from complete complementarity are therefore permissible, as long as such departures do not completely preclude the capacity of the molecules to form a double-stranded structure. Thus, in order for a nucleic acid molecule or a fragment of the nucleic acid molecule to serve as a primer or probe it needs only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in Current Protocols in Molecular Biology (1989). For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed. A nucleic acid for use in the present invention may specifically hybridize to one or more of nucleic acid molecules from WCR or complements thereof under such conditions. Preferably, a nucleic acid for use in the present invention will exhibit at least from about 80%, or at least from about 90%, or at least from about 95%, or at least from about 98% or even about 100% sequence identity with one or more nucleic acid molecules as set forth in SEQ ID NO:1 through SEQ ID NO:906 as set forth in the sequence listing.

Nucleic acids of the present invention may also be synthesized, either completely or in part, especially where it is desirable to provide plant-preferred sequences, by methods known in the art. Thus, all or a portion of the nucleic acids of the present invention may be synthesized using codons preferred by a selected host. Species-preferred codons may be determined, for example, from the codons used most frequently in the proteins expressed in a particular host species.

Other modifications of the nucleotide sequences may result in mutants having slightly altered activity.

dsRNA or siRNA nucleotide sequences comprise double strands of polymerized ribonucleotide and may include modifications to either the phosphate-sugar backbone or the nucleoside. Modifications in RNA structure may be tailored to allow specific genetic inhibition. In one embodiment, the dsRNA molecules may be modified through an enzymatic process so that siRNA molecules may be generated. The siRNA can efficiently mediate the down-regulation effect for some target genes in some insects. This enzymatic process may be accomplished by utilizing an RNAse III enzyme or a DICER enzyme, present in the cells of an insect, a vertebrate animal, a fungus or a plant in the eukaryotic RNAi pathway (Elbashir et al., 2002; Hamilton and Baulcombe, 1999). This process may also utilize a recombinant DICER or RNAse III introduced into the cells of a target insect through recombinant DNA techniques that are readily known to the skilled in the art. Both the DICER enzyme and RNAse III, being naturally occurring in an insect or being made through recombinant DNA techniques, cleave larger dsRNA strands into smaller oligonucleotides. The DICER enzymes specifically cut the dsRNA molecules into siRNA pieces each of which is about 19-25 nucleotides in length while the RNAse III enzymes normally cleave the dsRNA molecules into 12-15 base-pair siRNA. The siRNA molecules produced by the either of the enzymes have 2 to 3 nucleotide 3' overhangs, and 5' phosphate and 3' hydroxyl termini. The siRNA molecules generated by RNAse III enzyme are the same as those produced by Dicer enzymes in the eukaryotic RNAi pathway and are hence then targeted and degraded by an inherent cellular RNA-degrading mechanism after they are subsequently unwound, separated into single-stranded RNA and hybridize with the RNA sequences transcribed by the target gene. This process results in the effective degradation or removal of the RNA sequence encoded by the nucleotide sequence of the target gene in the insect. The outcome is the silencing of a particularly targeted nucleotide sequence within the insect. Detailed descriptions of enzymatic processes can be found in Hannon (2002).

A nucleotide sequence of the present invention can be recorded on computer readable media. As used herein, "computer readable media" refers to any tangible medium of expression that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; optical character recognition formatted computer files, and hybrids of these categories such as magnetic/optical storage media. A skilled artisan can readily appreciate that any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software that implements the BLAST (Altschul et al., 1990) and BLAZE (Brutlag, et al., 1993) search algorithms on a Sybase system can be used to identify open reading frames (ORFs) within sequences such as the Unigenes and EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As used herein, "a target structural motif," or "target motif," refers to any rationally selected sequence or combination of sequences in which the sequences or sequence(s) are chosen based on a three-dimensional configuration that is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

B. Recombinant Vectors and Host Cell Transformation

A recombinant DNA vector may, for example, be a linear or a closed circular plasmid. The vector system may be a single vector or plasmid or two or more vectors or plasmids that together contain the total DNA to be introduced into the genome of the bacterial host. In addition, a bacterial vector may be an expression vector. Nucleic acid molecules as set forth in SEQ ID NO:1 through SEQ ID NO:906 or fragments or complements thereof can, for example, be suitably inserted into a vector under the control of a suitable promoter that functions in one or more microbial hosts to drive expression of a linked coding sequence or other DNA sequence. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

Expression and cloning vectors generally contain a selection gene, also referred to as a selectable marker. This gene encodes a protein necessary for the survival or growth of transformed host cells grown in a selective culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. Those cells that are successfully transformed with a heterologous protein or fragment thereof produce a protein conferring drug resistance and thus survive the selection regimen.

An expression vector for producing a mRNA can also contain an inducible promoter that is recognized by the host bacterial organism and is operably linked to the nucleic acid encoding, for example, the nucleic acid molecule coding the *D. v. virgifera* mRNA or fragment thereof of interest. Inducible promoters suitable for use with bacterial hosts include β-lactamase promoter, *E. coli* λ phage PL and PR promoters, and *E. coli* galactose promoter, arabinose promoter, alkaline phosphatase promoter, tryptophan (trp) promoter, and the lactose operon promoter and variations thereof and hybrid promoters such as the tac promoter. However, other known bacterial inducible promoters are suitable.

The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream (5' noncoding sequences), within, or downstream (3' non-translated sequences) of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, and polyadenylation recognition sequences and the like.

Alternatively, the expression constructs can be integrated into the bacterial genome with an integrating vector. Integrating vectors typically contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP 0 127,328). Integrating vectors may also be comprised of bacteriophage or transposon sequences. Suicide vectors are also known in the art.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *D. v. virgifera* protein or fragment thereof, may be ligated into the vector in frame with sequences for the amino-terminal Met and the subsequent 7 residues of β-galactosidase so that a hybrid protein is produced; pIN vectors (Van Heeke and Schuster, 1989); and the like.

A yeast recombinant construct can typically include one or more of the following: a promoter sequence, fusion partner sequence, leader sequence, transcription termination sequence, a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al., 1979), pC1/1 (Brake et al., 1984), and YRp17 (Stinchcomb et al., 1982). In addition, a replicon may be either a high or low copy number plasmid. A high copy number plasmid will generally have a copy number ranging from about 5 to about 200, and typically about 10 to about 150. A host containing a high copy number plasmid will preferably have at least about 10, and more preferably at least about 20.

Useful yeast promoter sequences can be derived from genes encoding enzymes in the metabolic pathway. Examples of such genes include alcohol dehydrogenase (ADH) (EP 0 284044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EP 0 3215447). The yeast PHO5 gene, encoding acid phosphatase, also provides useful promoter sequences (Myanohara et al., 1983). In addition, synthetic promoters that do not occur in nature also function as yeast promoters. Examples of such hybrid promoters include the ADH regulatory sequence linked to the GAP transcription activation region (U.S. Pat. Nos. 4,876,197 and 4,880,734). Examples of transcription terminator sequences and other yeast-recognized termination sequences, such as those coding for glycolytic enzymes, are known to those of skill in the art.

Alternatively, the expression constructs can be integrated into the yeast genome with an integrating vector. Integrating vectors typically contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al., 1983). An integrating vector may be directed to a specific locus in yeast by selecting the appropriate homologous sequence for inclusion in the vector. See Orr-Weaver et al., supra. One or more expression constructs may integrate, possibly affecting levels of recombinant protein produced (Rine et al., 1983).

The present invention also contemplates transformation of a nucleotide sequence of the present invention into a plant to achieve pest inhibitory levels of expression of one or more dsRNA molecules. A transformation vector can be readily prepared using methods available in the art. The transformation vector comprises one or more nucleotide sequences that is/are capable of being transcribed to an RNA molecule and that is/are substantially homologous and/or complementary to one or more nucleotide sequences encoded by the genome of the insect, such that upon uptake of the RNA there is down-regulation of expression of at least one of the respective nucleotide sequences of the genome of the insect.

The transformation vector may be termed a dsDNA construct and may also be defined as a recombinant molecule, an insect control agent, a genetic molecule or a chimeric genetic construct. A chimeric genetic construct of the present invention may comprise, for example, nucleotide sequences encoding one or more antisense transcripts, one or more sense transcripts, one or more of each of the aforementioned, wherein all or part of a transcript therefrom is homologous to all or part of an RNA molecule comprising an RNA sequence encoded by a nucleotide sequence within the genome of an insect.

In one embodiment the plant transformation vector comprises an isolated and purified DNA molecule comprising a promoter operatively linked to one or more nucleotide sequences of the present invention. The nucleotide sequence is selected from the group consisting of SEQ ID NO:1 through SEQ ID NO:906 as set forth in the sequence listing. The nucleotide sequence includes a segment coding all or part of an RNA present within a targeted pest RNA transcript and may comprise inverted repeats of all or a part of a targeted pest RNA. The DNA molecule comprising the expression vector may also contain a functional intron sequence positioned either upstream of the coding sequence or even within the coding sequence, and may also contain a five prime (5') untranslated leader sequence (i.e., a UTR or 5'-UTR) positioned between the promoter and the point of translation initiation.

A plant transformation vector may contain sequences from more than one gene, thus allowing production of more than one dsRNA for inhibiting expression of two or more genes in cells of a target pest. One skilled in the art will readily appreciate that segments of DNA whose sequence corresponds to that present in different genes can be combined into a single composite DNA segment for expression in a transgenic plant. Alternatively, a plasmid of the present invention already containing at least one DNA segment can be modified by the sequential insertion of additional DNA segments between the enhancer and promoter and terminator sequences. In the insect control agent of the present invention designed for the inhibition of multiple genes, the genes to be inhibited can be obtained from the same insect species in order to enhance the effectiveness of the insect control agent. In certain embodiments, the genes can be derived from different insects in order to broaden the range of insects against which the agent is effective. When multiple genes are targeted for suppression or a combination of expression and suppression, a polycistronic DNA element can be fabricated as illustrated and disclosed in Fillatti, Application Publication No. US 2004-0029283.

Promoters that function in different plant species are also well known in the art. Promoters useful for expression of polypeptides in plants include those that are inducible, viral, synthetic, or constitutive as described in Odell et al. (1985), and/or promoters that are temporally regulated, spatially regulated, and spatio-temporally regulated. Preferred promoters include the enhanced CaMV35S promoters, and the FMV35S promoter. For the purpose of the present invention, e.g., for optimum control of species that feed on roots, it may be preferable to achieve the highest levels of expression of these genes within the roots of plants. A number of root-enhanced promoters have been identified and are known in the art (Lu et al., 2000; U.S. Pat. Nos. 5,837,848 and 6,489,542).

A recombinant DNA vector or construct of the present invention will typically comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene which codes for kanamycin resistance and can be selected for using kanamycin, G418, etc., a bar gene which codes for bialaphos resistance; a mutant EPSP synthase gene which encodes glyphosate resistance; a nitrilase gene which confers resistance to bromoxynil; a mutant acetolactate synthase gene (ALS) which confers imidazolinone or sulfonylurea resistance; and a methotrexate resistant DHFR gene. Examples of such selectable markers are illustrated in U.S. Pat. Nos. 5,550,318; 5,633,435; 5,780,708 and 6,118,047.

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, 1987; Jefferson et al., 1987); an R-locus gene, which encodes a product that regulates the production of anthocyanin pigments (red color) in plant tissues (Dellaporta et al., 1988); a β-lactamase gene (Sutcliffe et al., 1978), a gene which encodes an enzyme for which various chromogenic substrates are known (e.g., PADAC, a chromogenic cephalosporin); a luciferase gene (Ow et al., 1986) a xylE gene (Zukowsky et al., 1983) which encodes a catechol dioxygenase that can convert chromogenic catechols; an α-amylase gene (Ikatu et al., 1990); a tyrosinase gene (Katz et al., 1983) which encodes an enzyme capable of oxidizing tyrosine to DOPA and dopaquinone which in turn condenses to melanin; an α-galactosidase, which catalyzes a chromogenic α-galactose substrate.

Preferred plant transformation vectors include those derived from a Ti plasmid of *Agrobacterium tumefaciens* (e.g. U.S. Pat. Nos. 4,536,475, 4,693,977, 4,886,937, 5,501,967 and EP 0 122 791). *Agrobacterium rhizogenes* plasmids (or "Ri") are also useful and known in the art. Other preferred plant transformation vectors include those disclosed, e.g., by Herrera-Estrella (1983); Bevan (1983), Klee (1985) and EP 0 120 516.

In general it is preferred to introduce a functional recombinant DNA at a non-specific location in a plant genome. In special cases it may be useful to insert a recombinant DNA construct by site-specific integration. Several site-specific recombination systems exist which are known to function implants include cre-lox as disclosed in U.S. Pat. No. 4,959,317 and FLP-FRT as disclosed in U.S. Pat. No. 5,527,695.

Suitable methods for transformation of host cells for use with the current invention are believed to include virtually any method by which DNA can be introduced into a cell, such as by direct delivery of DNA such as by PEG-mediated transformation of protoplasts (Omirulleh et al., 1993), by desiccation/inhibition-mediated DNA uptake (Potrykus et al., 1985), by electroporation (U.S. Pat. No. 5,384,253), by agitation with silicon carbide fibers (Kaeppler et al., 1990; U.S. Pat. No. 5,302,523; and U.S. Pat. No. 5,464,765), by *Agrobacterium*-mediated transformation (U.S. Pat. No. 5,591,616 and U.S. Pat. No. 5,563,055) and by acceleration of DNA coated particles (U.S. Pat. No. 5,550,318; U.S. Pat. No. 5,538,877; and U.S. Pat. No. 5,538,880), etc. Through the application of techniques such as these, the cells of virtually any species may be stably transformed. In the case of multicellular species, the transgenic cells may be regenerated into transgenic organisms.

Methods for the creation of transgenic plants and expression of heterologous nucleic acids in plants in particular are known and may be used with the nucleic acids provided herein to prepare transgenic plants that exhibit reduced susceptibility to feeding by a target pest organism such as corn rootworms. Plant transformation vectors can be prepared, for example, by inserting the dsRNA producing nucleic acids disclosed herein into plant transformation vectors and introducing these into plants. One known vector system has been derived by modifying the natural gene transfer system of *Agrobacterium tumefaciens*. The natural system comprises large Ti (tumor-inducing)-plasmids containing a large segment, known as T-DNA, which is transferred to transformed plants. Another segment of the Ti plasmid, the vir region, is responsible for T-DNA transfer. The T-DNA region is bordered by terminal repeats. In the modified binary vectors the tumor-inducing genes have been deleted and the functions of the vir region are utilized to transfer foreign DNA bordered by the T-DNA border sequences. The T-region may also contain a selectable marker for efficient recovery of transgenic plants and cells, and a multiple cloning site for inserting sequences for transfer such as a dsRNA encoding nucleic acid.

A transgenic plant formed using *Agrobacterium* transformation methods typically contains a single simple recombinant DNA sequence inserted into one chromosome and is referred to as a transgenic event. Such transgenic plants can be referred to as being heterozygous for the inserted exogenous sequence. A transgenic plant homozygous with respect to a transgene can be obtained by selfing an independent segregant transgenic plant to produce F1 seed. One fourth of the F1 seed produced will be homozygous with respect to the transgene. Germinating F1 seed results in plants that can be tested for heterozygosity or homozygosity, typically using a SNP assay or a thermal amplification assay that allows for the distinction between heterozygotes and homozygotes (i.e., a zygosity assay).

C. Nucleic Acid Expression and Target Gene Suppression

The present invention provides, as an example, a transformed host or symbiont pest target organism, transformed plant cells and transformed plants and their progeny. The transformed plant cells and transformed plants may be engineered to express one or more of the dsRNA or siRNA sequences described herein to provide a pest-protective effect. These sequences may be used for gene suppression in a pest organism, thereby reducing the predation by the pest on a protected transformed host or symbiont organism. As used herein the words "gene suppression" are intended to refer to any of the well-known methods for reducing the levels of gene transcription to mRNA and/or subsequent translation of the mRNA.

Gene suppression is also intended to mean the reduction of protein expression from a gene or a coding sequence including posttranscriptional gene suppression and transcriptional suppression. Posttranscriptional gene suppression is mediated by the homology between of all or a part of a mRNA transcribed from a gene or coding sequence targeted for suppression and the corresponding double stranded RNA used for suppression, and refers to the substantial and measurable reduction of the amount of available mRNA available in the cell for binding by ribosomes. The transcribed RNA can be in the sense orientation to effect what is called co-suppression, in the anti-sense orientation to effect what is called anti-sense suppression, or in both orientations producing a dsRNA to effect what is called RNA interference (RNAi).

Transcriptional suppression is mediated by the presence in the cell of a dsRNA gene suppression agent exhibiting substantial sequence identity to a promoter DNA sequence or the complement thereof to effect what is referred to as promoter trans suppression. Gene suppression may be effective against a native plant gene associated with a trait, e.g., to provide plants with reduced levels of a protein encoded by the native gene or with enhanced or reduced levels of an affected metabolite. Gene suppression can also be effective against target genes in plant pests that may ingest or contact plant material containing gene suppression agents, specifically designed to inhibit or suppress the expression of one or more homologous or complementary sequences in the cells of the pest. Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Patent Application Publication No. 2003/0175965, and 2003/0061626, U.S. patent application Ser. No. 10/465,800, and U.S. Pat. Nos. 6,506,559, and 6,326,193.

A beneficial method of post transcriptional gene suppression in plants employs both sense-oriented and anti-sense-oriented, transcribed RNA which is stabilized, e.g., as a hairpin and stem and loop structure. A preferred DNA construct for effecting post transcriptional gene suppression is one in which a first segment encodes an RNA exhibiting an anti-sense orientation exhibiting substantial identity to a segment of a gene targeted for suppression, which is linked to a second segment in sense orientation encoding an RNA exhibiting substantial complementarity to the first segment. Such a construct forms a stem and loop structure by hybridization of the first segment with the second segment and a loop structure from the nucleotide sequences linking the two segments (see WO94/01550, WO98/05770, US 2002/0048814, and US 2003/0018993).

According to one embodiment of the present invention, there is provided a nucleotide sequence, for which in vitro expression results in transcription of a stabilized RNA sequence that is substantially homologous to an RNA molecule of a targeted gene in an insect that comprises an RNA sequence encoded by a nucleotide sequence within the genome of the insect. Thus, after the insect ingests the stabilized RNA sequence incorporated in a diet or sprayed on a plant surface, a down-regulation of the nucleotide sequence corresponding to the target gene in the cells of a target insect is affected.

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence have also been found to be effective for inhibition. In performance of the present invention, it is preferred that the inhibitory dsRNA and the portion of the target gene share at least from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that is capable of hybridizing with a portion of the target gene transcript. A less than full length sequence exhibiting a greater homology compensates for a longer less homologous sequence. The length of the identical nucleotide sequences may be at least about 25, 50, 100, 200, 300, 400, 500 or at least about 1000 bases. Normally, a sequence of greater than 20-100 nucleotides should be used, though a sequence of greater than about 200-300 nucleotides would be preferred, and a sequence of greater than about 500-1000 nucleotides would be especially preferred depending on the size of the target gene. The invention has the advantage of being able to tolerate sequence variations that might be expected due to genetic mutation, strain polymorphism, or evolutionary divergence. The introduced nucleic acid molecule may not need to be absolute homology, may not need to be full length, relative to either the primary transcription product or fully processed mRNA of the target gene. Therefore, those skilled in the art need to realize that, as disclosed herein, 100% sequence identity between the RNA and the target gene is not required to practice the present invention.

Inhibition of target gene expression may be quantified by measuring either the endogenous target RNA or the protein produced by translation of the target RNA and the consequences of inhibition can be confirmed by examination of the outward properties of the cell or organism. Techniques for quantifying RNA and proteins are well known to one of ordinary skill in the art. Multiple selectable markers are available that confer resistance to ampicillin, bleomycin, chloramphenicol, gentamycin, hygromycin, kanamycin, lincomycin, methotrexate, phosphinothricin, puromycin, spectinomycin, rifampicin, and tetracyclin, and the like.

In certain embodiments gene expression is inhibited by at least 10%, preferably by at least 33%, more preferably by at least 50%, and yet more preferably by at least 80%. In particularly preferred embodiments of the invention gene expression is inhibited by at least 80%, more preferably by at least 90%, more preferably by at least 95%, or by at least 99% within cells in the insect so a significant inhibition takes place. Significant inhibition is intended to refer to sufficient inhibition that results in a detectable phenotype (e.g., cessation of larval growth, paralysis or mortality, etc.) or a detectable decrease in RNA and/or protein corresponding to the target gene being inhibited. Although in certain embodiments of the invention inhibition occurs in substantially all cells of the insect, in other preferred embodiments inhibition occurs in only a subset of cells expressing the gene. For example, if the gene to be inhibited plays an essential role in cells in the insect alimentary tract, inhibition of the gene within these cells is sufficient to exert a deleterious effect on the insect.

dsRNA molecules may be synthesized either in vivo or in vitro. The dsRNA may be formed by a single self-complementary RNA strand or from two complementary RNA strands. Endogenous RNA polymerase of the cell may mediate transcription in vivo, or cloned RNA polymerase can be used for transcription in vivo or in vitro. Inhibition may be targeted by specific transcription in an organ, tissue, or cell type; stimulation of an environmental condition (e.g., infection, stress, temperature, chemical inducers); and/or engineering transcription at a developmental stage or age. The RNA strands may or may not be polyadenylated; the RNA strands may or may not be capable of being translated into a polypeptide by a cell's translational apparatus.

A RNA, dsRNA, siRNA, or miRNA of the present invention may be produced chemically or enzymatically by one skilled in the art through manual or automated reactions or in vivo in another organism. RNA may also be produced by partial or total organic synthesis; any modified ribonucleotide can be introduced by in vitro enzymatic or organic synthesis. The RNA may be synthesized by a cellular RNA polymerase or a bacteriophage RNA polymerase (e.g., T3, T7, SP6). The use and production of an expression construct are known in the art (see, for example, WO 97/32016; U.S. Pat. Nos. 5,593,874, 5,698,425, 5,712,135, 5,789,214, and 5,804,693). If synthesized chemically or by in vitro enzymatic synthesis, the RNA may be purified prior to introduction into the cell. For example, RNA can be purified from a mixture by extraction with a solvent or resin, precipitation, electrophoresis, chromatography, or a combination thereof. Alternatively, the RNA may be used with no or a minimum of purification to avoid losses due to sample processing. The RNA may be dried for storage or dissolved in an aqueous solution. The solution may contain buffers or salts to promote annealing, and/or stabilization of the duplex strands.

For transcription from a transgene in vivo or an expression construct, a regulatory region (e.g., promoter, enhancer, silencer, and polyadenylation) may be used to transcribe the RNA strand (or strands). Therefore, in one embodiment, the nucleotide sequences for use in producing RNA molecules may be operably linked to one or more promoter sequences functional in a microorganism, a fungus or a plant host cell. Ideally, the nucleotide sequences are placed under the control of an endogenous promoter, normally resident in the host genome. The nucleotide sequence of the present invention, under the control of an operably linked promoter sequence, may further be flanked by additional sequences that advantageously affect its transcription and/or the stability of a resulting transcript. Such sequences are generally located upstream of the operably linked promoter and/or downstream of the 3' end of the expression construct and may occur both upstream of the promoter and downstream of the 3' end of the expression construct, although such an upstream sequence only is also contemplated.

As used herein, the term "insect control agent", or "gene suppression agent" refers to a particular RNA molecule comprising a first RNA segment and a second RNA segment, wherein the complementarity between the first and the second RNA segments results in the ability of the two segments to hybridize in vivo and in vitro to form a double stranded molecule. It may generally be preferable to include a third RNA segment linking and stabilizing the first and second sequences such that the entire structure forms into a stem and loop structure, or even more tightly hybridizing structures may form into a stem-loop knotted structure. Alternatively, a symmetrical hairpin could be formed without a third segment in which there is no designed loop, but for steric reasons a hairpin would create its own loop when the stem is long enough to stabilize itself. The first and the second RNA segments will generally lie within the length of the RNA molecule and be substantially inverted repeats of each other and linked together by the third RNA segment. The first and the second segments correspond invariably and not respectively to a sense and an antisense sequence with respect to the target RNA transcribed from the target gene in the target insect pest that is suppressed by the ingestion of the dsRNA molecule. The insect control agent can also be a substantially purified (or isolated) nucleic acid molecule and more specifically nucleic acid molecules or nucleic acid fragment molecules thereof from a genomic DNA (gDNA) or cDNA library. Alternatively, the fragments may comprise smaller oligonucleotides having from about 15 to about 250 nucleotide residues, and more preferably, about 15 to about 30 nucleotide residues.

As used herein, the term "genome" as it applies to cells of an insect or a host encompasses not only chromosomal DNA found within the nucleus, but organelle DNA found within subcellular components of the cell. The DNA's of the present invention introduced into plant cells can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated or plasmid-localized.

As used herein, the term "pest" refers to insects, arachnids, crustaceans, fungi, bacteria, viruses, nematodes, flatworms, roundworms, pinworms, hookworms, tapeworms, trypanosomes, schistosomes, botflies, fleas, ticks, mites, and lice and the like that are pervasive in the human environment and that may ingest or contact one or more cells, tissues, or fluids produced by a pest host or symbiont transformed to express or coated with a double stranded gene suppression agent or that may ingest plant material containing the gene suppression agent. As used herein, a "pest resistance" trait is a characteristic of a transgenic plant, transgenic animal, transgenic host or transgenic symbiont that causes the plant, animal, host, or symbiont to be resistant to attack from a pest that typically is capable of inflicting damage or loss to the plant, animal, host or symbiont. Such pest resistance can arise from a natural mutation or more typically from incorporation of recombinant DNA that confers pest resistance. To impart insect resistance to a transgenic plant a recombinant DNA can, for example, be transcribed into a RNA molecule that forms a dsRNA molecule within the tissues or fluids of the recombinant plant. The dsRNA molecule is comprised in part of a segment of RNA that is identical to a corresponding RNA segment encoded from a DNA sequence within an insect pest that prefers to feed on the recombinant plant. Expression of the gene within the target insect pest is suppressed by the dsRNA, and the suppression of expression of the gene in the target insect pest results in the plant being insect resistant. Fire et al. (U.S. Pat. No. 6,506,599) generically described inhibition of pest infestation, providing specifics only about several nucleotide sequences that were effective for inhibition of gene function in the nematode species *Caenorhabditis elegans*. Similarly, Plaetinck et al. (US 2003/0061626) describe the use of dsRNA for inhibiting gene function in a variety of nematode pests. Mesa et al. (US 2003/0150017) describe using dsDNA sequences to transform host cells to express corresponding dsRNA sequences that are substantially identical to target sequences in specific pathogens, and particularly describe constructing recombinant plants expressing such dsRNA sequences for ingestion by various plant pests, facilitating down-regulation of a gene in the genome of the pest and improving the resistance of the plant to the pest infestation.

The present invention provides for inhibiting gene expression of one or multiple target genes in a target pest using stabilized dsRNA methods. The invention is particularly useful in the modulation of eukaryotic gene expression, in particular the modulation of expression of genes present in pests that exhibit a digestive system pH level that is from about 4.5 to about 9.5, more preferably from about 5.0 to about 8.0, and even more preferably from about 6.5 to about 7.5. For plant pests with a digestive system that exhibits pH levels outside of these ranges, delivery methods may be desired for use that do not require ingestion of dsRNA molecules.

The modulatory effect of dsRNA is applicable to a variety of genes expressed in the pests including, for example, endogenous genes responsible for cellular metabolism or cellular transformation, including house keeping genes, transcription factors and other genes which encode polypeptides involved in cellular metabolism.

As used herein, the phrase "inhibition of gene expression" or "inhibiting expression of a target gene in the cell of an insect" refers to the absence (or observable decrease) in the level of protein and/or mRNA product from the target gene. Specificity refers to the ability to inhibit the target gene without manifest effects on other genes of the cell and without any effects on any gene within the cell that is producing the dsRNA molecule. The inhibition of gene expression of the target gene in the insect pest may result in novel phenotypic traits in the insect pest.

The present invention provides in part a delivery system for the delivery of the insect control agents to insects through their exposure to a diet containing the insect control agents of the present invention. In accordance with one of the embodiments, the stabilized dsRNA or siRNA molecules may be incorporated in the insect diet or may be overlaid on the top of the diet for consumption by an insect. The present invention also provides in part a delivery system for the delivery of the insect control agents to insects through their exposure to a microorganism or host such as a plant containing the insect control agents of the present invention by ingestion of the microorganism or the host cells or the contents of the cells. In accordance with another embodiment, the present invention involves generating a transgenic plant cell or a plant that contains a recombinant DNA construct transcribing the stabilized dsRNA molecules of the present invention. As used herein, the phrase "generating a transgenic plant cell or a plant" refers to the methods of employing the recombinant DNA technologies readily available in the art (e.g., by Sambrook, et al., 1989) to construct a plant transformation vector transcribing the stabilized dsRNA molecules of the present invention, to transform the plant cell or the plant and to generate the transgenic plant cell or the transgenic plant that contain the transcribed, stabilized dsRNA molecules.

In still another embodiment, non-pathogenic, attenuated strains of microorganisms may be used as a carrier for the insect control agents and, in this perspective, the microorganisms carrying such agents are also referred to as insect control agents. The microorganisms may be engineered to express a nucleotide sequence of a target gene to produce RNA molecules comprising RNA sequences homologous or complementary to RNA sequences typically found within the cells of an insect. Exposure of the insects to the microorganisms result in ingestion of the microorganisms and down-regulation of expression of target genes mediated directly or indirectly by the RNA molecules or fragments or derivatives thereof.

The present invention alternatively provides exposure of an insect to the insect control agents of the present invention incorporated in a spray mixer and applied to the surface of a host, such as a host plant. In an exemplary embodiment, ingestion of the insect control agents by an insect delivers the insect control agents to the gut of the insect and subsequently to the cells within the body of the insect. In another embodiment, infection of the insect by the insect control agents through other means such as by injection or other physical methods also permits delivery of the insect control agents. In yet another embodiment, the RNA molecules themselves are encapsulated in a synthetic matrix such as a polymer and applied to the surface of a host such as a plant. Ingestion of the host cells by an insect permits delivery of the insect control agents to the insect and results in down-regulation of a target gene in the host.

It is envisioned that the compositions of the present invention can be incorporated within the seeds of a plant species either as a product of expression from a recombinant gene incorporated into a genome of the plant cells, or incorporated into a coating or seed treatment that is applied to the seed before planting. The plant cell containing a recombinant gene is considered herein to be a transgenic event.

It is believed that a pesticidal seed treatment can provide significant advantages when combined with a transgenic event that provides protection from coleopteran pest infestation that is within the preferred effectiveness range against a target pest. In addition, it is believed that there are situations that are well known to those having skill in the art, where it is advantageous to have such transgenic events within the preferred range of effectiveness.

The present invention provides in part a delivery system for the delivery of insect control agents to insects. The stabilized dsRNA or siRNA molecules of the present invention may be directly introduced into the cells of an insect, or introduced into an extracellular cavity, interstitial space, lymph system, digestive system, into the circulation of the insect through oral ingestion or other means that one skilled in the art may employ. Methods for oral introduction may include direct mixing of RNA with food of the insect, as well as engineered approaches in which a species that is used as food is engineered to express the dsRNA or siRNA, then fed to the insect to be affected. In one embodiment, for example, the dsRNA or siRNA molecules may be incorporated into, or overlaid on the top of, the insect's diet. In another embodiment, the RNA may be sprayed onto a plant surface. In still another embodiment, the dsRNA or siRNA may be expressed by microorganisms and the microorganisms may be applied onto a plant surface or introduced into a root, stem by a physical means such as an injection. In still another embodiment, a plant may be genetically engineered to express the dsRNA or siRNA in an amount sufficient to kill the insects known to infect the plant.

Specifically, in practicing the present invention in WCR, the stabilized dsRNA or siRNA may be introduced in the midgut inside the insect and achieve the desired inhibition of the targeted genes. The dsRNA or siRNA molecules may be incorporated into a diet or be overlaid on the diet as discussed above and may be ingested by the insects. In any event, the dsRNA's of the present invention are provided in the diet of the target pest. The target pest of the present invention will exhibit a digestive tract pH from about 4.5 to about 9.5, or from about 5 to about 8.5, or from about 6 to about 8, or from about 6.5 to about 7.7, or about 7.0. The digestive tract of a target pest is defined herein as the location within the pest that food that is ingested by the target pest is exposed to an environment that is favorable for the uptake of the dsRNA molecules of the present invention without suffering a pH so extreme that the hydrogen bonding between the double-strands of the dsRNA are caused to dissociate and form single stranded molecules.

It is also anticipated that dsRNA's produced by chemical or enzymatic synthesis may be formulated in a manner consistent with common agricultural practices and used as spray-on products for controlling insect infestations. The formulations may include the appropriate stickers and wetters required for efficient foliar coverage as well as UV protectants to protect dsRNAs from UV damage. Such additives are commonly used in the bioinsecticide industry and are well known to those skilled in the art. Such applications could be combined with other spray-on insecticide applications, biologically based or not, to enhance plant protection from insect feeding damage.

The present inventors contemplate that bacterial strains producing insecticidal proteins may be used to produce dsRNAs for insect control purposes. These strains may exhibit improved insect control properties. A variety of different bacterial hosts may be used to produce insect control dsRNAs. Exemplary bacteria may include *E. coli, B. thuringiensis, Pseudomonas* sp., *Photorhabdus* sp., *Xenorhabdus* sp., *Serratia entomophila* and related *Serratia* sp., *B. sphaericus, B. cereus, B. laterosporus, B. popilliae, Clostridium bifermentans* and other *Clostridium* species, or other spore-forming gram-positive bacteria. In certain embodiments, bacteria may be engineered for control of pests such as mosquitoes.

The present invention also relates to recombinant DNA constructs for expression in a microorganism. Exogenous nucleic acids from which an RNA of interest is transcribed can be introduced into a microbial host cell, such as a bacterial cell or a fungal cell, using methods known in the art.

The nucleotide sequences of the present invention may be introduced into a wide variety of prokaryotic and eukaryotic microorganism hosts to produce the stabilized dsRNA or siRNA molecules. The term "microorganism" includes prokaryotic and eukaryotic microbial species such as bacteria, fungi and algae. Fungi include yeasts and filamentous fungi, among others. Illustrative prokaryotes, both Gram-negative and Gram-positive, include *Enterobacteriaceae*, such as *Escherichia, Erwinia, Shigella, Salmonella*, and *Proteus; Bacillaceae; Rhizobiceae*, such as *Rhizobium; Spirillaceae*, such as photobacterium, *Zymomonas, Serratia, Aeromonas, Vibrio, Desulfovibrio, Spirillum; Lactobacillaceae; Pseudomonadaceae*, such as *Pseudomonas* and *Acetobacter; Azotobacteraceae, Actinomycetales*, and *Nitrobacteraceae*. Among eukaryotes are fungi, such as *Phycomycetes* and *Ascomycetes*, which includes yeast, such as *Saccharomyces* and *Schizosaccharomyces*; and *Basidiomycetes*, such as *Rhodotorula, Aureobasidium, Sporobolomyces*, and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies *B. thuringiensis kurstaki* HD-1, *B. thuringiensis kurstaki* HD-73, *B. thuringiensis sotto, B. thuringiensis berliner, B. thuringiensis thuringiensis, B. thuringiensis tolworthi, B. thuringiensis dendrolimus, B. thuringiensis alesti, B. thuringiensis galleriae, B. thuringiensis aizawai, B. thuringiensis subtoxicus, B. thuringiensis entomocidus, B. thuringiensis tenebrionis* and *B. thuringiensis san diego*); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc*, and *Alcaligenes*; fungi, particularly yeast, e.g., genera *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum, Agrobacterium tumefaciens, Rhodobacter sphaeroides, Xanthomonas campestris, Rhizobium melioti, Alcaligenes eutrophus*, and *Azotobacter vinlandii*; and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*.

D. Transgenic Plants

The present invention provides seeds and plants having one or more transgenic event. Combinations of events are referred to as "stacked" transgenic events. These stacked transgenic events can be events that are directed at the same target pest, or they can be directed at different target pests. In one embodiment, a seed having the ability to express a nucleic acid provided herein also has the ability to express at least one other insecticidal agent, including, but not limited to, an RNA molecule the sequence of which is derived from the sequence of an RNA expressed in a target pest and that forms a double stranded RNA structure upon expressing in the seed or cells of a plant grown from the seed, wherein the ingestion of one or more cells of the plant by the target pest results in the suppression of expression of the RNA in the cells of the target pest.

In certain embodiments, a seed having the ability to express a dsRNA the sequence of which is derived from a target pest also has a transgenic event that provides herbicide tolerance. One beneficial example of a herbicide tolerance gene provides resistance to glyphosate, N-(phosphonomethyl) glycine, including the isopropylamine salt form of such herbicide.

In the present method, combination of expression of an insecticidal amount of a dsRNA within the cells of a transgenic seed or plant grown from the seed coupled with treatment of the seed or plant with certain chemical or protein pesticides may be used to provide unexpected synergistic advantages, including unexpectedly superior efficacy for protection against damage to the resulting transgenic plant by the target pest. In particular embodiments, treatment of a transgenic seed that is capable of expressing certain constructs that form dsRNA molecules, the sequence of which are derived from one or more sequences expressed in a corn rootworm, with from about 100 gm to about 400 gm of pesticide per 100 kg of seed provides unexpectedly superior protection against corn rootworm. In addition, it is believed that such combinations are also effective to protect the emergent plants against predation by other pests. The seeds of the present invention may also be used to decrease the cost of pesticide use, because less pesticide can be used to obtain a required amount of protection than when such methods are not used. Moreover, because less pesticide is used and because it is applied prior to planting and without a separate field application, it is believed that the subject method is therefore safer to the operator and to the environment, and is potentially less expensive than conventional methods.

By "synergistic" it is meant to include the synergistic effects of the combination on the pesticidal activity (or efficacy) of the combination of the transgenic event and the pesticide. However, it is not intended that such synergistic effects be limited to the pesticidal activity, but that they should also include such unexpected advantages as increased scope of activity, advantageous activity profile as related to type and amount of damage reduction, decreased cost of pesticide and application, decreased pesticide distribution in the environment, decreased pesticide exposure of personnel who produce, handle and plant corn seeds, and other advantages known to those skilled in the art.

Pesticides and insecticides that are useful in compositions in combination with the methods and compositions of the present invention, including as seed treatments and coatings as well as methods for using such compositions can be found, for example, in U.S. Pat. No. 6,551,962, the entirety of which is incorporated herein by reference.

Although it is believed that the seed treatments can be applied to a transgenic seed in any physiological state, it may be preferred that the seed be in a sufficiently durable state that it incurs no damage during the treatment process. Typically, the seed would be a seed that had been harvested from the field; removed from the transgenic plant; and separated from any other non-seed plant material. The seed would preferably also be biologically stable to the extent that the treatment-would cause no biological damage to the seed. In one embodiment, for example, the treatment can be applied to seed corn that has been harvested, cleaned and dried to a moisture content below about 15% by weight. In an alternative embodiment, the seed can be one that has been dried and then primed with water and/or another material and then re-dried before or during the treatment with the pesticide. Within the limitations described, it is believed that the treatment can be applied to the seed at any time between harvest of the seed and sowing of the seed. As used herein, the term "unsown seed" is meant to include seed at any period between the harvest of the seed and the sowing of the seed in the ground for the purpose of germination and growth of the plant. When it is said that unsown seed is "treated" with the pesticide, such treatment is not meant to include those practices in which the pesticide is applied to the soil, rather than to the seed. For example, such treatments as the application of the pesticide in bands, "T"-bands, or in-furrow, at the same time as the seed is sowed are not considered to be included in the present invention.

The pesticide, or combination of pesticides, can be applied "neat", that is, without any diluting or additional components present. However, the pesticide is typically applied to the seeds in the form of a pesticide formulation. This formulation may contain one or more other desirable components including but not limited to liquid diluents, binders to serve as a matrix for the pesticide, fillers for protecting the seeds during stress conditions, and plasticizers to improve flexibility, adhesion and/or spreadability of the coating.

The subject pesticides can be applied to a seed as a component of a seed coating. Seed coating methods and compositions that are known in the art are useful when they are modified by the addition of one of the embodiments of the combination of pesticides of the present invention. Such coating methods and apparatus for their application are disclosed in, for example, U.S. Pat. Nos. 5,918,413, 5,891,246, 5,554, 445, 5,389,399, 5,107,787, 5,080,925, 4,759,945 and 4,465, 017. Seed coating compositions are disclosed, for example, in U.S. Pat. Nos. 5,939,356, 5,882,713, 5,876,739, 5,849,320, 5,834,447, 5,791,084, 5,661,103, 5,622,003, 5,580,544, 5,328,942, 5,300,127, 4,735,015, 4,634,587, 4,383,391, 4,372,080, 4,339,456, 4,272,417 and 4,245,432, among others.

The pesticides that are useful in the coating are those pesticides that are described herein. The amount of pesticide that is used for the treatment of the seed will vary depending upon the type of seed and the type of active ingredients, but the treatment will comprise contacting the seeds with an amount of the combination of pesticides that is pesticidally effective. When insects are the target pest, that amount will be an amount of the insecticide that is insecticidally effective. As used herein, an insecticidally effective amount means that amount of insecticide that will kill insect pests in the larvae or pupal state of growth, or will consistently reduce or retard the amount of damage produced by insect pests.

In general, the amount of pesticide that is applied to the seed in the treatment will range from about 10 gm to about 2000 gm of the active ingredient of the pesticide per 100 kg of the weight of the seed. Preferably, the amount of pesticide will be within the range of about 50 gm to about 1000 gm active per 100 kg of seed, more preferably within the range of about 100 gm to about 600 gm active per 100 kg of seed, and even more preferably within the range of about 200 gm to about 500 gm of active per 100 kg of seed weight. Alternatively, it has been found to be preferred that the amount of the pesticide be over about 60 gm of the active ingredient of the pesticide per 100 kg of the seed, and more preferably over about 80 gm per 100 kg of seed.

The pesticides that are used in the treatment must not inhibit germination of the seed and should be efficacious in protecting the seed and/or the plant during that time in the target insect's life cycle in which it causes injury to the seed or plant. In general, the coating will be efficacious for approximately 0 to 120 days after sowing. The pesticides of the subject invention can be applied to the seed in the form of a coating.

Benefits provided by the present invention may include, but are not limited to: the ease of introducing dsRNA into the insect cells, the low concentration of dsRNA which can be used, the stability of dsRNA, and the effectiveness of the inhibition. The ability to use a low concentration of a stabilized dsRNA avoids several disadvantages of anti-sense interference. The present invention is not limited to in vitro use or to specific sequence compositions, to a particular set of target genes, a particular portion of the target gene's nucleotide sequence, or a particular transgene or to a particular delivery method, as opposed to the some of the available techniques known in the art, such as antisense and co-suppression. Furthermore, genetic manipulation becomes possible in organisms that are not classical genetic models.

In practicing the present invention, selections can be carried out to ensure that the presence of the nucleotide sequences that are transcribed from the recombinant construct are not harmful to non-pest cells. This can be achieved by targeting genes that exhibit a low degree of sequence identity with corresponding genes in a plant or a vertebrate animal. Preferably the degree of the sequence identity is less than approximately 80%. More preferably the degree of the sequence identity is less than approximately 70%. Most preferably the degree of the sequence identity is less than approximately 60%.

In addition to direct transformation of a plant with a recombinant DNA construct, transgenic plants can be prepared by crossing a first plant having a recombinant DNA construct with a second plant lacking the construct. For example, recombinant DNA for gene suppression can be introduced into first plant line that is amenable to transformation to produce a transgenic plant that can be crossed with a second plant line to introgress the recombinant DNA for gene suppression into the second plant line.

The present invention can be, in practice, combined with other insect control traits in a plant to achieve desired traits for enhanced control of insect infestation. Combining insect control traits that employ distinct modes-of-action can provide insect-protected transgenic plants with superior durability over plants harboring a single insect control trait because of the reduced probability that resistance will develop in the field.

The mechanism of insecticidal activity of *B. thuringiensis* crystal proteins has been studied extensively in the past decade. It has been shown that the crystal proteins are toxic to the larval form of the insect only after ingestion of the protein. In lepidopteran larvae, an alkaline pH and proteolytic enzymes in the insect mid-gut solubilize the proteins, thereby allowing the release of components that are toxic to the insect. These toxic components disrupt the mid-gut cells, cause the insect to cease feeding, and, eventually, bring about insect death. For this reason, *B. thuringiensis* toxins have proven themselves to be effective and environmentally safe insecticides in dealing with various insect pests. Coleopteran and hemipteran insects, and likely dipteran, lygus and other piercing and sucking insects exhibit a gut pH that is slightly acidic, and so the Bt toxins that are effective against lepidopteran larvae are ineffective against these pests. The slightly acidic pH of the gut of these insects is also believed to be more hospitable to the compositions of the present invention, and without intending to be limited to a particular theory, it is likely that the alkaline pH of the gut of lepidopteran larvae is a contributing reason that prior attempts to exhibit dsRNA efficacy has failed (Fire et al. U.S. Pat. No. 6,506,559; Mesa et al. Patent Publication No. US2003/0150017; Rajagopal et al., 2002; Tabara et al., 1998). It is believed therefore that the dsRNA methods disclosed herein should be preferentially used in compositions and in plants to control coleopteran, dipteran, hemipteran, lygus, and piercing and sucking insects. The methods and compositions set forth herein are particularly useful for targeting genes for suppression in insects exhibiting a gut pH of from about 4.5 to about 9.5, or from about 5.0 to about 9.0, or from about 5.5 to about 8.5, or from about 6.0 to about 8.0, or from about 6.5 to about 7.7, or from about 6.8 to about 7.6, or about 7.0. However, insects and other pest species that exhibit a gut pH of from about 7.5 to about 11.5, or from about 8.0 to about 11.0, or from about 9.0 to about 10.0, such as lepidopteran insect larvae, are also intended to be within the scope of the present invention. This is particularly true when a dsRNA specific for inhibiting a gene in a lepidopteran larvae is provided in the diet of the larvae along with one or more Bt proteins, that, with respect to the Bt protein would ordinarily be toxic to that lepidopteran larvae when provided at or above a threshold level. The presence of one or more Bt toxins toxic to the same insect species would effectively reduce the gut pH, providing a stable environment for the double stranded RNA molecules to exert their effects in suppressing a target gene in the insect pest.

It is anticipated that the combination of certain stabilized dsRNA constructs with one or more insect control protein genes will result in synergies that enhance the insect control phenotype of a transgenic plant. Insect bioassays employing artificial diet- or whole plant tissue can be used to define dose-responses for larval mortality or growth inhibition using both dsRNAs and insect control proteins. One skilled in the art can test mixtures of dsRNA molecules and insect control proteins in bioassay to identify combinations of actives that are synergistic and desirable for deployment in insect-protected plants (Tabashnik, 1992). Synergy in killing insect pests has been reported between different insect control proteins (for review, see Schnepf et al., 1998). It is anticipated that synergies will exist between certain dsRNAs and between certain dsRNAs and certain insect control proteins.

The invention also relates to commodity products containing one or more of the sequences of the present invention, and produced from a recombinant plant or seed containing one or more of the nucleotide sequences of the present invention are specifically contemplated as embodiments of the present invention. A commodity product containing one or more of the sequences of the present invention is intended to include, but not be limited to, meals, oils, crushed or whole grains or seeds of a plant, or any food product comprising any meal, oil, or crushed or whole grain of a recombinant plant or seed containing one or more of the sequences of the present invention. The detection of one or more of the sequences of the present invention in one or more commodity or commodity products contemplated herein is defacto evidence that the commodity or commodity product is composed of a transgenic plant designed to express one or more of the nucleotides sequences of the present invention for the purpose of controlling insect infestation using dsRNA mediated gene suppression methods.

D. Obtaining Nucleic acids

The present invention provides a method for obtaining a nucleic acid comprising a nucleotide sequence for producing a dsRNA or siRNA. In one embodiment, such a method comprises: (a) probing a cDNA or gDNA library with a hybridization probe comprising all or a portion of a nucleotide sequence or a homolog thereof from a targeted insect; (b) identifying a DNA clone that hybridizes with the hybridization probe; (c) isolating the DNA clone identified in step (b); and (d) sequencing the cDNA or gDNA fragment that comprises the clone isolated in step (c) wherein the sequenced nucleic acid molecule transcribes all or a substantial portion of the RNA nucleotide acid sequence or a homolog thereof.

In another embodiment, a method of the present invention for obtaining a nucleic acid fragment comprising a nucleotide sequence for producing a substantial portion of a dsRNA or siRNA comprises: (a) synthesizing first and a second oligonucleotide primers corresponding to a portion of one of the nucleotide sequences from a targeted insect; and (b) amplifying a cDNA or gDNA template in a cloning vector using the first and second oligonucleotide primers of step (a) wherein the amplified nucleic acid molecule transcribes a substantial portion of a dsRNA or siRNA of the present invention.

In practicing the present invention, a target gene may be derived from a corn rootworm (CRW), such as a WCR or a SCR, or any insect species that causes damage to the crop plants and subsequent yield losses. It is contemplated that several criteria may be employed in the selection of preferred target genes. The gene is one whose protein product has a rapid turnover rate, so that dsRNA inhibition will result in a rapid decrease in protein levels. In certain embodiments it is advantageous to select a gene for which a small drop in expression level results in deleterious effects for the insect. If it is desired to target a broad range of insect species a gene is selected that is highly conserved across these species. Conversely, for the purpose of conferring specificity, in certain embodiments of the invention, a gene is selected that contains regions that are poorly conserved between individual insect species, or between insects and other organisms. In certain embodiments it may be desirable to select a gene that has no known homologs in other organisms.

As used herein, the term "derived from" refers to a specified nucleotide sequence that may be obtained from a particular specified source or species, albeit not necessarily directly from that specified source or species.

In one embodiment, a gene is selected that is expressed in the insect gut. Targeting genes expressed in the gut avoids the requirement for the dsRNA to spread within the insect. Target genes for use in the present invention may include, for example, those that share substantial homologies to the nucleotide sequences of known gut-expressed genes that encode protein components of the vacuolar and plasma membrane proton V-ATPase (Dow et al., 1997; Dow, 1999). This protein complex is the sole energizer of epithelial ion transport and is responsible for alkalinization of the midgut lumen. The V-ATPase is also expressed in the Malpighian tubule, an outgrowth of the insect hindgut that functions in fluid balance and detoxification of foreign compounds in a manner analogous to a kidney organ of a mammal. In another embodiment, the V-ATPase may be Vha68-2, or a homolog or ortholog thereof (e.g. as found in SEQ ID NO:821).

In another embodiment, a gene is selected that is essentially involved in the growth, development, and reproduction of an insect. Exemplary genes include but are not limited to a CHD3 gene, a β-tubulin gene, and a gene encoding a protein predicted to be involved in transport. The CHD3 gene in *Drosophila melanogaster* encodes a protein with ATP-dependent DNA helicase activity that is involved in chromatin assembly/disassembly in the nucleus. Similar sequences have been found in diverse organisms such as *Arabidopsis thaliana, Caenorhabditis elegans*, and *Saccharomyces cerevisiae*. The beta-tubulin gene family encodes microtubule-associated proteins that are a constituent of the cellular cytoskeleton. Related sequences are found in such diverse organisms as *C. elegans*, and *Manduca sexta*. Proteins predicted to be subunits of the endosomal sorting complex required for transport (ESCRT)-III (Babst et al., 2002), e.g. Dv49, are found in diverse organisms including mammals, yeast, and insects such as *D. virgifera*. Another transport-related protein is the β'-coatomer protein, abbreviated as β'Cop, that encodes a product involved in retrograde (Golgi to ER) transport. Similar or predicted sequences have been identified in *C. elegans* and *D. virgifera*, e.g. Dv248 (SEQ ID NO:.

Other target genes for use in the present invention may include, for example, those that play important roles in the viability, growth, development, reproduction and infectivity. These target genes may be one of the house keeping genes, transcription factors and insect specific genes or lethal knock-out mutations in *Drosophila*. The target genes for use in the present invention may also be those that are from other organisms, e.g., from a nematode (e.g., *C. elegans*). Additionally, the nucleotide sequences for use in the present invention may also be derived from plant, viral, bacterial or fungal genes whose functions have been established from literature and the nucleotide sequences of which share substantial similarity with the target genes in the genome of an insect. According to one aspect of the present invention for WCR control, the target sequences may essentially be derived from the targeted WCR insect. Some of the exemplary target sequences from cDNA library from WCR that encode *D. virgifera* proteins or fragments thereof which are homologues of known proteins may be found in the Sequence Listing. Nucleic acid molecules from *D. virgifera* encoding homologs of known proteins are known (Andersen et al., U.S. patent application Ser. No. 10/205,189).

For the purpose of the present invention, the dsRNA or siRNA molecules may be obtained from the CRW by polymerase chain (PCR™) amplification of a target CRW gene sequences derived from a corn rootworm gDNA or cDNA library or portions thereof. The WCR larvae may be prepared using methods known to the ordinary skilled in the art and DNA/RNA may be extracted. Larvae with various sizes ranging from 1st instars to fully-grown CRWs may be used for the purpose of the present invention for DNA/RNA extraction. Genomic DNA or cDNA libraries generated from WCR may be used for PCR™ amplification for production of the dsRNA or siRNA.

The target genes may be then be PCR™ amplified and sequenced using the methods readily available in the art. One skilled in the art may be able to modify the PCR™ conditions to ensure optimal PCR™ product formation. The confirmed PCR™ product may be used as a template for in vitro transcription to generate sense and antisense RNA with the included minimal promoters.

The present inventors contemplate that nucleic acid sequences identified and isolated from any insect species in the insect kingdom may be used in the present invention for control of WCR and another targeted insects. In one aspect of the present invention, the nucleic acid may be derived from a coleopteran species. Specifically, the nucleic acid may be derived from leaf beetles belonging to the genus *Diabrotica* (*Coleoptera, Chrysomelidae*) and more specifically the nucleic acid molecules of the present invention may be derived from species in the *virgifera* group. Most specifically, the nucleic acid molecules of the present invention may be derived from *Diabrotica virgifera virgifera* LeConte that is normally referred to as WCR. The isolated nucleic acids may be useful, for example, in identifying a target gene and in constructing a recombinant vector that produce stabilized dsRNAs or siRNAs of the present invention for protecting plants from WCR insect infestations.

Therefore, in one embodiment, the present invention comprises isolated and purified nucleotide sequences from WCR or Lygus that may be used as the insect control agents. The isolated and purified nucleotide sequences may comprise those as set forth in the sequence listing.

The nucleic acids from WCR or other insects that may be used in the present invention may also comprise isolated and substantially purified Unigenes and EST nucleic acid molecules or nucleic acid fragment molecules thereof. EST nucleic acid molecules may encode significant portions of, or indeed most of, the polypeptides. Alternatively, the fragments may comprise smaller oligonucleotides having from about 15 to about 250 nucleotide residues, and more preferably, about 15 to about 30 nucleotide residues. Alternatively, the nucleic acid molecules for use in the present invention may be from cDNA libraries from WCR, or from any other coleopteran pest species.

Nucleic acid molecules and fragments thereof from WCR, or other coleopteran pest species may be employed to obtain other nucleic acid molecules from other species for use in the present invention to produce desired dsRNA and siRNA molecules. Such nucleic acid molecules include the nucleic acid molecules that encode the complete coding sequence of a protein and promoters and flanking sequences of such molecules. In addition, such nucleic acid molecules include nucleic acid molecules that encode for gene family members. Such molecules can be readily obtained by using the above-described nucleic acid molecules or fragments thereof to screen, for instance, cDNA or gDNA libraries obtained from *D. v. virgifera* or other coleopterans, or from *Lygus hesperus*. Methods for forming such libraries are well known in the art.

As used herein, the phrase "coding sequence", "structural nucleotide sequence" or "structural nucleic acid molecule" refers to a nucleotide sequence that is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, EST and recombinant nucleotide sequences.

The term "recombinant DNA" or "recombinant nucleotide sequence" refers to DNA that contains a genetically engineered modification through manipulation via mutagenesis, restriction enzymes, and the like.

For many of the insects that are potential targets for control by the present invention, there may be limited information regarding the sequences of most genes or the phenotype resulting from mutation of particular genes. Therefore, the present inventors contemplate that selection of appropriate genes from insect pests for use in the present invention may be accomplished through use of information available from study of the corresponding genes in a model organism such in *Drosophila*, in some other insect species, or even in a nematode species, in a fungal species, in a plant species, in which the genes have been characterized. In some cases it will be possible to obtain the sequence of a corresponding gene from a target insect by searching databases such as GenBank using either the name of the gene or the sequence from, for example, *Drosophila*, another insect, a nematode, a fungus, or a plant from which the gene has been cloned. Once the sequence is obtained, PCR™ may be used to amplify an appropriately selected segment of the gene in the insect for use in the present invention.

In order to obtain a DNA segment from the corresponding gene in an insect species, PCR™ primers may be designed based on the sequence as found in WCR or other insects from which the gene has been cloned. The primers are designed to amplify a DNA segment of sufficient length for use in the present invention. DNA (either genomic DNA or cDNA) is prepared from the insect species, and the PCR™ primers are used to amplify the DNA segment. Amplification conditions are selected so that amplification will occur even if the primers do not exactly match the target sequence. Alternately, the gene (or a portion thereof) may be cloned from a gDNA or cDNA library prepared from the insect pest species, using the WCR gene or another known insect gene as a probe. Techniques for performing PCR™ and cloning from libraries are known. Further details of the process by which DNA segments from target insect pest species may be isolated based on the sequence of genes previously cloned from WCR or other insect species are provided in the Examples. One of ordinary skill in the art will recognize that a variety of techniques may be used to isolate gene segments from insect pest species that correspond to genes previously isolated from other species.

When an insect is the target pest for the present invention, such pests include but are not limited to: from the order Lepidoptera, for example,

*Acleris* spp., *Adoxophyes* spp., *Aegeria* spp., *Agrotis* spp., *Alabama argillaceae*, *Amylois* spp., *Anticarsia gemmatalis*, *Archips* spp, *Argyrotaenia* spp., *Autographa* spp., *Busseola fusca*, *Cadra cautella*, *Carposina nipponensis*, *Chilo* spp., *Choristoneura* spp., *Clysia ambiguella*, *Cnaphalocrocis* spp., *Cnephasia* spp., *Cochylis* spp., *Coleophora* spp., *Crocidolomia binotalis*, *Cryptophlebia leucotreta*, *Cydia* spp., *Diatraea* spp., *Diparopsis castanea*, *Earias* spp., *Ephestia* spp., *Eucosma* spp., *Eupoecilia ambiguella*, *Euproctis* spp., *Euxoa* spp., *Grapholita* spp., *Hedya nubiferana*, *Heliothis* spp., *Hellula undalis*, *Hyphantria cunea*, *Keiferia lycopersicella*, *Leucoptera scitella*, *Lithocollethis* spp., *Lobesia botrana*, *Lymantria* spp., *Lyonetia* spp., *Malacosoma* spp., *Mamestra brassicae*, *Manduca sexta*, *Operophtera* spp., *Ostrinia Nubilalis*, *Pammene* spp., *Pandemis* spp., *Panolis flammea*, *Pectinophora gossypiella*, *Phthorimaea operculella*, *Pieris rapae*, *Pieris* spp., *Plutella xylostella*, *Prays* spp., *Scirpophaga* spp., *Sesamia* spp., *Sparganothis* spp., *Spodoptera* spp., *Synanthedon* spp., *Thaumetopoea* spp., *Tortrix* spp., *Trichoplusia ni* and *Yponomeuta* spp.;

from the order Coleoptera, for example,

*Agriotes* spp., *Anthonomus* spp., *Atomaria linearis*, *Chaetocnema tibialis*, *Cosmopolites* spp., *Curculio* spp., *Dermestes* spp., *Diabrotica* spp., *Epilachna* spp., *Eremnus* spp., *Leptinotarsa decemlineata*, *Lissorhoptrus* spp., *Melolontha* spp., *Orycaephilus* spp., *Otiorhynchus* spp., *Phlyctinus* spp., *Popillia* spp., *Psylliodes* spp., *Rhizopertha* spp., *Scarabeidae*, *Sitophilus* spp., *Sitotroga* spp., *Tenebrio* spp., *Tribolium* spp. and *Trogoderma* spp.;

from the order Orthoptera, for example,

*Blatta* spp., *Blattella* spp., *Gryllotalpa* spp., *Leucophaea maderae*, *Locusta* spp., *Periplaneta* ssp., and *Schistocerca* spp.;

from the order Isoptera, for example,

*Reticulitemes* ssp;

from the order Psocoptera, for example,

*Liposcelis* spp.;

from the order Anoplura, for example,

*Haematopinus* spp., *Linognathus* spp., *Pediculus* spp., *Pemphigus* spp. and *Phylloxera* spp.;

from the order Mallophaga, for example,

*Damalinea* spp. and *Trichodectes* spp.;

from the order Thysanoptera, for example,

*Franklinella* spp., *Hercinothrips* spp., *Taeniothrips* spp., *Thrips palmi*, *Thrips tabaci* and *Scirtothrips aurantii;* from the order Heteroptera, for example,

*Cimex* spp., *Distantiella theobroma*, *Dysdercus* spp., *Euchistus* spp., *Eurygaster* spp., *Leptocorisa* spp., *Nezara* spp., *Piesma* spp., *Rhodnius* spp., *Sahlbergella singularis*, *Scotinophara* spp., *Triatoma* spp., Miridae family spp. such as *Lygus hesperus* and *Lygus lineoloris*, Lygaeidae family spp. such as *Blissus leucopterus*, and Pentatomidae family spp.;

from the order *Homoptera*, for example,

*Aleurothrixus floccosus*, *Aleyrodes brassicae*, *Aonidiella* spp., *Aphididae*, *Aphis* spp., *Aspidiotus* spp., *Bemisia tabaci*, *Ceroplaster* spp., *Chrysomphalus aonidium*, *Chrysomphalus dictyospermi*, *Coccus hesperidum*, *Empoasca* spp., *Eriosoma larigerum*, *Erythroneura* spp., *Gascardia* spp., *Laodelphax* spp., *Lacanium corni*, *Lepidosaphes* spp., *Macrosiphus* spp., *Myzus* spp., *Nehotettix* spp., *Nilaparvata* spp., *Paratoria* spp., *Pemphigus* spp., *Planococcus* spp., *Pseudaulacaspis* spp., *Pseudococcus* spp., *Psylla* ssp., *Pulvinaria aethiopica*, *Quadraspidiotus* spp., *Rhopalosiphum* spp., *Saissetia* spp., *Scaphoideus* spp., *Schizaphis* spp., *Sitobion* spp., *Trialeurodes vaporariorum*, *Trioza erytreae* and *Unaspis citri*;

from the order Hymenoptera, for example,

*Acromyrmex*, *Atta* spp., *Cephus* spp., *Diprion* spp., *Diprionidae*, *Gilpinia polytoma*, *Hoplocampa* spp., *Lasius* sppp., *Monomorium pharaonis*, *Neodiprion* spp, *Solenopsis* spp. and *Vespa* ssp.;

from the order Diptera, for example,

*Aedes* spp., *Antherigona soccata*, *Bibio hortulanus*, *Calliphora erythrocephala*, *Ceratitis* spp., *Chrysomyia* spp., *Culex* spp., *Cuterebra* spp., *Dacus* spp., *Drosophila melanogaster*, *Fannia* spp., *Gastrophilus* spp., *Glossina* spp., *Hypoderma* spp., *Hyppobosca* spp., *Liriomysa* spp., *Lucilia* spp., *Melanagromyza* spp., *Musca* ssp., *Oestrus* spp., *Orseolia* spp., *Oscinella frit*, *Pegomyia hyoscyami*, *Phorbia* spp., *Rhagoletis pomonella*, *Sciara* spp., *Stomoxys* spp., *Tabanus* spp., *Tannia* spp. and *Tipula* spp., from the order Siphonaptera, for example,

*Ceratophyllus* spp. *und Xenopsylla cheopis* and from the order Thysanura, for example,

*Lepisma saccharina*.

It has been found that the present invention is particularly effective when the insect pest is a *Diabrotica* spp., and especially when the pest is *Diabrotica virgifera virgifera* (Western Corn Rootworm, WCR), *Diabrotica barberi* (Northern Corn Rootworm, NCR), *Diabrotica virgifera zea* (Mexican Corn Rootworm, MCR), *Diabrotica balteata* (Brazilian Corn Rootworm (BZR) or Brazilian Corn Rootworm complex (BCR) consisting of *Diabrotica viridula* and *Diabrotica speciosa*), or *Diabrotica undecimpunctata howardi* (Southern Corn Rootworm, SCR).

EXAMPLES

The inventors herein have identified means for controlling coleopteran pest infestation by providing a double stranded ribonucleic acid molecules in the diet of pests. Surprisingly, the inventors have discovered double stranded ribonucleic acid molecules that function upon ingestion by the pest to inhibit a biological function in the pest, resulting in one or more of the following attributes: reduction in feeding by the pest, reduction in viability of the pest, death of the pest, inhibition of differentiation and development of the pest, absence of or reduced capacity for sexual reproduction by the pest, muscle formation, juvenile hormone formation, juvenile hormone regulation, ion regulation and transport, maintenance of cell membrane potential, amino acid biosynthesis, amino acid degradation, sperm formation, pheromone synthesis, pheromone sensing, antennae formation, wing formation, leg formation, development and differentiation, egg formation, larval maturation, digestive enzyme formation, haemolymph synthesis, haemolymph maintenance, neurotransmission, cell division, energy metabolism, respiration, apoptosis, and any component of a eukaryotic cells' cytoskeletal structure, such as, for example, actins and tubulins. Any one or any combination of these attributes can result in an effective inhibition of pest infestation, and in the case of a plant pest, inhibition of plant infestation. For example, when used as a diet composition containing a pest inhibitory sufficient amount of one or more double stranded ribonucleic acid molecules provided topically to a plant, as a seed treatment, as a soil application around a plant, or when produced by a plant from a recombinant DNA molecule present within the cells of a plant, plant pest infestation is unexpectedly dramatically reduced. The Examples set forth herein below are illustrative of the invention when applied to a single pest. However, the skilled artisan will recognize that the methods, formulae, and ideas presented in the Examples are not intended to be limiting, and are applicable to all coleopteran pest species that can consume food sources that can be formulated to contain a sufficient amount of a pest inhibitory agent consisting at least of one or more double stranded RNA molecules exemplified herein intended to suppress some essential feature about or function within the pest.

Example 1

Identification of Target Nucleotide Sequences For Preparation of dsRNA Useful for Controlling Corn Rootworms Corn rootworm cDNA libraries (LIB149, LIB 150, LIB33027, LIB3373) were constructed from whole larvae, pupae and from dissected midgut sections, and nucleotide sequence information was obtained (see Andersen et al., U.S. patent application Ser. No. 10/205,189 filed Jul. 24, 2002, incorporated herein specifically by reference in its entirety). In addition, cDNA libraries were constructed from whole larvae at different developmental stages and at different times within each developmental stage in order to maximize the number of different EST sequences from the *Diabrotica* species. Libraries LIB5444 and LIB5462 were constructed respectively from mRNA pools obtained from first (1 gram) and third (2.9 grams) instar Western Corn Rootworm larvae. Harvested insects were rapidly frozen by insertion into liquid nitrogen. The insects were ground in a mortar and pestle maintained at or below −20° C. by chilling on dry ice and/or with the addition of liquid nitrogen to the mortar until the tissue was ground into a fine powder. RNA was extracted using TRIzol® reagent (Invitrogen) according to the manufacturer's instructions. Poly A+ RNA was isolated from the total RNA prep using DYNABEADS Oligo dT (Invitrogen) following the manufacturer's instructions. A cDNA library was constructed from the Poly A+ RNA using the SuperScript™ Plasmid System (Invitrogen). cDNA was size fractionated using chromatography. The fourth and fifth fractions were collected and ligated into the pSPORT1 vector (Life Technologies Inc., Gaithersburg Md.) between the SalI and NotI restriction endonucleases recognition sites, and transformed into *E. coli* DH10B electro-competent cells by electroporation. The first instar larvae library yielded about 420,000 colony-forming units. The third instar larvae library yielded about $2.78 \times 10^6$ colony forming units. Colonies from LIB149, LIB150 were washed from the plates, mixed to uniformity by vortexing briefly, and pooled into Tris-EDTA buffer. Half of the wash was brought to 10% glycerol, aliquoted into cryovials, and stored at −70° C. The other half was used to produce plasmid DNA using a Quiagen midi-prep purification column, or its equivalent. Purified plasmid DNA was aliquoted to microcentrifuge tubes and stored at −20° C.

Colonies from the *Diabrotica virgifera* cDNA libraries LIB5444 and LIB5462 were amplified individually in a high viscosity medium. Approximately 200,000 colony-forming units from LIB5444 and 600,000 colony-forming units from LIB5462 were mixed on a stir plate separately in 500 ml LB medium containing 0.3% SeaPrep Agarose® and 50 mg/l carbenecillin at 37° C. and then rapidly cooled in a water/ice bath for 1 hour allowing uniform suspension of the bacterial colonies. The inoculated libraries were then grown at 30° C. for 42 hours. After incubation, the cells were mixed for 5 minutes on a stir plate. The medium was then transferred to two 250 ml centrifuge bottles. The bacterial cells were pelleted at 10,000×g for 10 minutes. The medium was removed from the bottles and the cells were resuspended in a total of 20 ml of LB medium with 50 mg/l carbenecillin. Dimethyl sulfoxide was added to 10% to preserve the cells in freezing. Both libraries were amplified to a final titer of $10^8$ colony-forming units per milliliter. Samples of the *Diabrotica virgifera* cDNA libraries LIB5444 and LIB5462 were combined and adjusted to a DNA concentration of about 1.25 micrograms per microliter in sterile distilled and deionized water and aliquoted into twenty five cryovials, each cryovial containing about 8.75 micrograms of DNA. These samples were deposited by the applicant(s)/inventors with the American Type Culture Collection (ATCC) located at 10801 University Boulevard, Manassas, Va., USA ZIP 20110-2209 on Jun. 10, 2004 and referred to as LIB5444/62. The ATCC provided the Applicant with a deposit receipt, assigning the ATCC Deposit Accession No. PTA-6072.

Corn rootworm high molecular weight cDNA libraries, i.e., LIB5496 and LIB5498, were prepared essentially as described above for the production of corn rootworm cDNA libraries. Libraries LIB5496 and LIB5498 were constructed respectively from mRNA pools obtained from first (1 gram) and second and third (1 gram) instar Western Corn Rootworm larvae. Briefly, insects were quickly frozen in liquid nitrogen. The frozen insects were reduced to a fine powder by grinding in a mortar and pestle. RNA was extracted using TRIzol® reagent (Invitrogen) following the manufacturer's instructions. Poly A+ RNA was isolated from the total RNA prep using DYNABEADS Oligo dT (Invitrogen). A high molecular weight cDNA library was made from 20 micrograms of Poly A+ RNA using the SuperScript™ Plasmid System (Invitrogen). The cDNA was size fractionated on a 1% agarose gel in TAE, and cDNA between the range of 1 Kb to 10 Kb was collected and ligated into the pSPORT1 vector in between the Sal1 and Not1 restriction sites and transformed into *E. coli* DH10B electro-competent cells by electroporation. LIB5496 yielded a total titer of about $3.5×10^6$ colony forming units. LIB5498 yielded a total titer of about $1.0×10^6$ colony forming units. Colonies from the corn rootworm high molecular weight cDNA libraries LIB5496 and LIB5498 were amplified individually in a high viscosity medium. Approximately 600,000 colony-forming units from LIB5496 and LIB5498 were mixed on a stir plate separately in 500 ml LB medium containing 0.3% SeaPrep Agarose® and 50 mg/l carbenecillin at 37° C. and then rapidly cooled in a water/ice bath for 1 hour allowing uniform suspension of the bacterial colonies. The libraries were then grown at 30° C. for 42 hours. After incubation, the cells were mixed for 5 minutes on a stir plate. The medium was then transferred to two 250 mL centrifuge bottles. The bacterial cells were pelleted at 10,000×g for 10 minutes. The medium was removed from the bottles and the cells were resuspended in a total of 20 mL of LB medium with 50 mg/L carbenecillin. Dimethyl sulfoxide was added to 10% to preserve the cells in freezing. Both libraries were amplified to a final titer of $10^8$ colony-forming units per milliliter. Inserted cDNA sequence information was obtained from the corn rootworm species-specific plasmid libraries.

The Andersen et al. rootworm libraries together with additional sequences from the libraries LIB5444 and LIB5462 initially produced about 18,415 individual EST sequences consisting of approximately $1.0×10^7$ nucleotide residues. The average length of an EST sequence was about 586 nucleotide residues. These EST sequences were subjected to bioinformatics algorithms that resulted in the assembly of contig sequences referred to herein as UNIGENE sequences, and individual EST sequences that could not be compiled by overlap identity with other EST sequences, referred to herein as singletons. The LIB5444 and LIB5462 libraries were then sequenced much deeper, resulting in additional individual EST sequences. EST sequences obtained from libraries, i.e., LIB149, LIB150, LIB3027, LIB3373, LIB5444, LIB5462, LIB5496 and LIB5503 were selected for further investigation in feeding bioassays as set forth below and the corresponding sequences are given in the sequence listing.

The EST sequences isolated from CRW cDNA libraries were assembled, where possible, into UNIGENE sets and these assembled Unigene sequences are included in the sequence listing. A UNIGENE is a gene-oriented cluster formed from the overlap of individual EST sequences within regions of sequence identity to form a larger sequence. Pontius et al. (2003). Each nucleotide sequence as set forth in the sequence listing was analyzed to identify the presence of open reading frames. Amino acid sequence information deduced from open reading frames was compared to known amino acid sequence information available in public databases in order to deduce the extent of amino acid sequence identity or similarity to those known amino acid sequences. Biological function, if any, associated with known amino acid sequences in public databases was annotated to the amino acid sequences deduced from the cDNA library nucleotide sequence information. Annotations provided information that was suggestive of the function of a protein that may be expressed from a particular gene that gave rise to a particular cDNA sequence, but was not outcome determinative. Based on the suggestive annotation information, certain cDNA sequences were characterized as those that encoded a protein that was likely involved in some biological function within corn rootworm cells that was either essential to life, or that was necessary for ensuring health and vitality to a cell, or were likely to be involved in cellular integrity, cell maintenance, reproductive capacity, and the like.

Sequences selected for further investigation were used in the construction of double stranded RNA molecules for incorporation into CRW diet. Thermal amplification primer pairs were designed based on cDNA and EST starting sequences to obtain sequences used in feeding assays. Primer pairs were constructed either as a pair of nucleotide sequences, each member of a primer pair exhibiting perfect complementarity either to a sense or to an antisense sequence. Some primer pair sequences were constructed so that each member of the pair exhibited a sequence containing a T7 phage RNA polymerase promoter at it's 5' end. Preferably a higher fidelity first amplification reaction was carried out using a first primer pair lacking a T7 promoter to generate a first amplicon using CRW genomic DNA as template. Preferably, a cDNA or a mRNA sequence is used as the template for the synthesis of a dsRNA molecule for use in the present invention because eukaryotic genome sequences are recognized in the art to contain sequences that are not present within the mature RNA molecule. A sample of the first amplicon generated from the higher fidelity first amplification reaction was then used as template in a second thermal amplification reaction with a second primer pair containing the T7 promoter sequence to produce a second amplicon that contained a T7 promoter at or embedded within the 5' end of each strand of the second amplicon. The complete nucleotide sequence of the second amplicon was obtained in both directions and compared to the nucleotide sequence as reported for the cDNA, and discrepancies between the two sequences, if any, were noted. Generally, sequences prepared using genome DNA as template were inconsistent with further use as dsRNA molecules for use in achieving significant levels of suppression because of variations within the genome sequences that were not present within the mRNA or cDNA sequence.

An in vitro transcription reaction typically contained from about 1 to about 2 micrograms of linearized DNA template, T7 polymerase reaction buffer from a 10× concentrate, ribonucleotides ATP, CTP, GTP, and UTP at a final concentration of from between 50 and 100 mM each, and 1 unit of T7 RNA polymerase enzyme. The RNA polymerase reaction was incubated at about 37° C., depending on the optimal temperature of the RNA polymerase used according to the manufacturers' instructions, for a period of time ranging from several minutes to several hours. Generally, reactions were carried out for from about 2 to about 6 hours for transcription of template sequences up to about 400 nucleotides in length, and for up to 20 hours for transcription of template sequences greater than about 400 nucleotides in length. Heating the reaction to 65° C. for fifteen minutes terminates RNA transcription. RNA transcription products were precipitated in ethanol, washed, air dried and resuspended in RNAse free water to a concentration of about 1 microgram per microliter. Most transcripts which took advantage of the opposing T7 promoter strategy outlined above produced double stranded RNA in the in vitro transcription reaction, however, a higher yield of double stranded RNA was obtained by heating the purified RNA to 65° C. and then slowly cooling to room temperature to ensure proper annealing of sense and antisense RNA segments. Double stranded RNA products were then incubated with DNAse I and RNAse at 37° C. for one hour to remove any DNA or single stranded RNA present in the mixture. Double stranded RNA products were purified over a column according to the manufacturers' instructions (AMBION MEGAscript® RNAi KIT) and resuspended in 10 mM Tris-HCl buffer (pH 7.5) or RNAse free water to a concentration of between 0.1 and 1.0 microgram per microliter.

The following nucleotide sequences were derived first as cDNA sequences identified in a corn rootworm mid-gut cDNA library (Andersen et al., ibid), and were adapted for use in constructing double stranded RNA molecules for use in testing the efficacy of inhibiting a biological function in a pest by feeding double stranded RNA molecules in the diet of the pest.

A. Chd3 Homologous Sequences

CHD genes have been identified in numerous eukaryotes, and the corresponding proteins are proposed to function as chromatin-remodeling factors. The term CHD is derived from the three domains of sequence homology found in CHD proteins: a chromo (chromatin organization modifier) domain, a SNF2-related helicase/ATPase domain, and a DNA-binding domain, each of which is believed to confer a distinct chromatin-related activity. CHD proteins are separated into two categories based on the presence or absence of another domain of sequence homology, a PHD zinc finger domain, typically associated with chromatin related activity. CHD3 related proteins possess a PHD zinc finger domain, but CHD1 related proteins do not. Experimental observations have suggested a role for CHD3 proteins in repression of transcription, and in some species have been shown to be a component of a complex that contains histone deacetylase as a subunit. Deacetylation of histones is correlated with transcriptional inactivation, and so CHD3 proteins have been implicated to function as repressors of transcription by virtue of being a component of a histone deacetylase complex (Ogas et al., 1999). Thus, suppression of CHD3 protein synthesis may be a useful target for double stranded RNA mediated inhibition of coleopteran pests.

B. Beta-Tubulin Homologous Sequences

Tubulin proteins are important structural components of many cellular structures in all eukaryote cells and principally in the formation of microtubules. Inhibition of microtubule formation in cells results in catastrophic effects including interference with the formation of mitotic spindles, blockage of cell division, and the like. Therefore, suppression of tubulin protein formation may be a useful target for double stranded RNA mediated inhibition.

C. 40 kDa V-ATPase Homologous Sequences

Energy metabolism within subcellular organelles in eukaryotic systems is an essential function. Vacuolar ATP synthases are involved in maintaining sufficient levels of ATP within vacuoles. Therefore, vacuolar ATP synthases may be a useful target for double stranded RNA mediated inhibition.

D. EF1α Homologous Sequences

Transcription elongation and transcription termination factors are essential to metabolism and may be advantageous targets for double stranded RNA mediated inhibition.

E. 26S Proteasome Subunit p28 Homologous Sequences

The 26S proteasome is a large, ATP-dependent, multi-subunit protease that is highly conserved in all eukaryotes. It has a general function in the selective removal of various short-lived proteins that are first covalently linked to ubiquitin and then subsequently degraded by the 26S proteasome complex. The ubiquitin pathway plays an important role in the control of the cell cycle by the specific degradation of a number of regulatory proteins including mitotic cyclins and inhibitors of cyclin-dependent kinases such as p27 of mammalian cells. Thus, the suppression of 26S proteasome synthesis and suppression of synthesis of its component subunits may be preferred targets for double stranded RNA mediated inhibition. (Smith et al., 1997).

F. Juvenile Hormone Epoxide Hydrolase Homologous Sequences

Insect juvenile hormone controls and regulates a variety of necessary biological processes within the insect life cycle including but not necessarily limited to metamorphosis, reproduction, and diapause. Juvenile hormone (JH) concentrations are required to peak at appropriate times within the haemolymph of the larval form of an insect pest, in particular lepidopteran and coleopteran larvae, and then must be degraded in order to terminate the effects of the hormone response. Enzymes involved in decreasing the concentration of juvenile hormone are effective through two primary pathways of metabolic degradation. One pathway involves juvenile hormone esterase (JHE), which hydrolyzes the methyl ester providing the corresponding acid. The second pathway utilizes juvenile hormone epoxide hydrolase (JHEH) to achieve hydrolysis of the epoxide, resulting in formation of the diol. The contribution of JHE in the degradation of JH is well understood and has been found to be invariate between the *lepidoptera* and *coleoptera* species. Inhibition of JH esterase has been associated with severe morphological changes including but not limited to larval wandering, deferred pupation, and development of malformed intermediates. In contrast, the contribution of JHEH in JH metabolism is less well understood and had been shown to vary between the species, but recent studies point to evidence that suggests that JHEH may be the primary route of metabolism of JH (Brandon J. Fetterolf, Doctoral Dissertation, North Carolina State University (Feb. 10, 2002) Synthesis and Analysis of Mechanism Based Inhibitors of Juvenile Hormone Epoxide Hydrolase from Insect *Trichoplusia ni*). In any event, disruption of either JH degradation pathway using gene suppression technology could be an effective target for double stranded RNA mediated pest inhibition.

G. Swelling Dependent Chloride Channel Protein Homologous Sequences

Swelling dependent chloride channel proteins have been postulated to play a critical role in osmoregulation in eukaryotic animal cell systems. Therefore, a nucleotide sequence exhibiting the ability to express an amino acid sequence that exhibits homology to previously identified swelling dependent chloride channel proteins may be a useful target for RNA inhibition in a pest.

H. Glucose-6-phosphate 1-dehydrogenase Protein Homologous Sequences

Glucose-6-phosphate 1-dehydrogenase protein (G6PD) catalyzes the oxidation of glucose-6-phosphate to 6-phosphogluconate while concomitantly reducing the oxidized form of nicotinamide adenine dinucleotide phosphate (NADP+) to NADPH. NADPH is known in the art as a required cofactor in many eukaryotic biosynthetic reactions, and is known to maintain glutathione in its reduced form. Reduced glutathione acts as a scavenger for dangerous oxidative metabolites in eukaryotic cells, and with the assistance of the enzyme glutathione peroxidase, convert harmful hydrogen peroxide to water (Beutler et al., 1991). Therefore, G6PD may be a preferable target for double stranded RNA mediated inhibition in a coleopteran pest.

I. Act42A Protein Homologous Sequences

Actin is a ubiquitous and highly conserved eukaryotic protein required for cell motility and locomotion (Lovato et al., 2001). A number of CRW cDNA sequences were identified that were predicted to likely encode actin or proteins exhibiting amino acid sequence structure related to actin proteins. Therefore, genes encoding actin homologues in a pest cell may be useful targets for double stranded RNA mediated inhibition.

J. ADP-ribosylation Factor 1 Homologous Sequences

ADP ribosylation factors have been demonstrated to be essential in cell function in that they play integral roles in the processes of DNA damage repair, carcinogenesis, cell death, and genomic stability. Thus, it would be useful to be able to selectively disrupt transcription of ADP-ribosylation factors in coleopteran pest species using double stranded RNA mediated inhibition.

K. Transcription Factor IIB Protein Homologous Sequences

Transcription elongation and transcription termination factors, as indicated above, are essential to metabolism and may be advantageous targets for double stranded RNA mediated inhibition to control or eliminate coleopteran pest infestation.

L. Chitinase Homologous Sequences

Chitin is a β(1→4)homopolymer of N-acetylglucosamine and is found in insect exoskeletons. Chitin is formed from UDP-N-acetlglucosamine in a reaction catalyzed by chitin synthase. Chitin is a structural homopolymer polysaccharide, and there are many enzymatic steps involved in the construction of this highly branched and cross-linked structure. Chitin gives shape, rigidity and support to insects and provides a scaffolding to which internal organs such as muscles are attached. Chitin must also be degraded to some extent to mediate the steps involved in the insect molting process. Therefore, it is believed that double stranded RNA mediated inhibition of proteins in these pathways would be useful as a means for controlling coleopteran pest infestation.

M. Ubiquitin Conjugating Enzyme Homologous Sequences

The ubiquitin pathway plays an important role in the control of the cell cycle by the specific degradation of a number of regulatory proteins including mitotic cyclins and inhibitors of cyclin-dependent kinases such as p27 of mammalian cells. Thus, genes encoding ubiquitin and associated components may be a preferred target for double stranded RNA mediated inhibition. (Smith et al., 1997). The ubiquitin-dependent proteolytic pathway is one of the major routes by which intracellular proteins are selectively destroyed in eukaryotes. Conjugation of ubiquitin to substrate proteins is mediated by a remarkably diverse array of enzymes. Proteolytic targeting may also be regulated at steps between ubiquitination of the substrate and its degradation to peptides by the multi-subunit 26S protease. The complexity of the ubiquitin system suggests a central role for protein turnover in eukaryotic cell regulation, and implicates other proteins in the pathway including ubiquitin-activating enzyme, ubiquitin-conjugating enzyme, ubiquitin-protein ligase, and 26S proteasome subunit components. Therefore, it is believed that double stranded RNA mediated inhibition of proteins in this pathway would be useful as a means for controlling coleopteran pest infestation.

N. Glyceraldehyde-3-phosphate Dehydrogenase Homologous Sequences

The glycolytic pathway is an essential pathway in most organisms and is involved in the production of metabolic energy from the degradation of glucose. One important enzyme in the second stage of the glycolytic pathway is glyceraldehyde-3-phosphate dehydrogenase (G3PDH), which, in the presence of NAD+ and inorganic phosphate, catalyzes the oxidation of 3-phospho-glyceraldehyde to 3-phosphoglyceroyl-phosphate along with the formation of NADH. The important component of this reaction is the storage of energy through the formation of NADH. Genes encoding enzymes associated with the glycolytic pathway, and particularly genes: encoding enzymes involved in the steps useful in formation of energy reserves may be particularly useful targets for double stranded RNA mediated inhibition in coleopteran pest species.

O. Ubiquitin B Homologous Sequences

As described above, the ubiquitin protein degradation pathway plays an important role in the control of the cell cycle by the specific degradation of a number of regulatory proteins including mitotic cyclins and inhibitors of cyclin-dependent kinases such as p27 of mammalian cells. Thus, genes encoding ubiquitin and associated components may be a preferred target for double stranded RNA mediated inhibition. (Smith et al., 1997).

P. Juvenile Hormone Esterase Homologs

As indicated above, insect juvenile hormone controls and regulates a variety of necessary biological processes within the insect life cycle including but not necessarily limited to metamorphosis, reproduction, and diapause. Disruption of JH synthesis or degradation pathways using gene suppression technology could be an effective target for double stranded RNA mediated pest inhibition.

Q. Alpha Tubulin Homologous Sequences

Eukaryotic cells generally utilize cytoskeletal structural elements that are important, not only as a mechanical scaffold, but also in sustaining the shape of the cell. Semiflexible microfilaments make cells mobile, help them to divide in mitosis (cytokinesis) and, in vertebrate and invertebrate animals, are responsible for muscular contraction. The relatively stiff microtubules which are made up of alpha and beta tubulin proteins play an important role in acting as a sort of highway for transport of vesicles and organelles and in the separation of chromosomes during mitosis (karyokinesis). The flexible intermediate filaments provide at least additional strength to the overall cellular structure. The cytoskeleton is also known to be involved in signaling across the cell cytoplasm. Taking these functions into account, it is believed that any disruption of the cytoskeleton or even subtle changes of its integrity may cause pathological consequences to a cell.

R. Transport Related Sequences

As indicated above, sorting and transport of various molecules within a cell, including to appropriate organelles, as well as their secretion is an important physiological function. Such sorting pathways could include those relying on the endosomal sorting complex required for transport (ESCRT), complexes I-III, among others. Thus, functions related to transport of polypeptides and other molecules may also be a preferred target for dsRNA-mediated inhibition.

Example 2

Insect Feeding Bioassays

Samples of double stranded RNA (dsRNA) were subjected to bioassay with a selected number of target pests. The dsRNA was prepared from sequences identified according to Example 1 using either a full contig sequence in the case of SEQ ID Nos: 1-6, or a sequence amplified from the assembled contig using the primer pairs as set forth in the sequence listing. Varying does of dsRNA were applied as an overlay to corn rootworm artificial diet according to the following procedure. *Diabrotica virgifera virgifera* (WCR) eggs were obtained from Crop Characteristics, Inc., Farmington, Minn. The non-diapausing WCR eggs were incubated in soil for about 13 days at 24C, 60% relative humidity, in complete darkness. On day 13 the soil containing WCR eggs was placed between #30 and #60 mesh sieves and the eggs were washed out of the soil using a high pressure garden hose. The eggs were surface disinfested by soaking in LYSOL for three minutes, rinsed three times with sterile water, washed one time with a 10% formalin solution and then rinsed three additional times in sterile water. Eggs treated in this way were dispensed onto sterile coffee filters and hatched overnight at 27° C., 60% relative humidity, in complete darkness.

To prepare dsRNA, amplicons of selected sequences were cloned into a plasmid vector capable of replication in *E. coli* and sufficient amounts of plasmid DNA was recovered to allow for in vitro T7 RNA polymerase transcription from the embedded convergent T7 promoters at either end of the cloned fragment. Double stranded RNA was produced and subjected to bioassay; one RNA segment comprising the sequence as set forth in the sequence listing, the other RNA segment being substantially the reverse complement of the nucleotide sequence, uridines appropriately positioned in place of thymidines. A sample of double stranded RNA (dsRNA) was treated with DICER or with RNAse III to produce sufficient quantities of small interfering RNA's (siRNA). Samples containing siRNA or dsRNA were overlayed onto CRW diet bioassay as described above and larvae were allowed to feed as set forth below.

A sample of double stranded RNA was either added directly to each well containing insect diet as indicated above, or was modified prior to being added to insect diet. Modification of double stranded RNA followed the instructions for RNAse III (AMBION CORPORATION, Austin, Tex.) or DICER (STRATAGENE, La Jolla, Calif.) provided by the manufacturer. RNAse III digestion of double stranded RNA produced twenty-one and twenty-two nucleotide duplexes containing 5' phosphorylated ends and 3' hydroxyl ends with 2-3 base overhangs, similar to the ~21-26 base pair duplexed short interfering RNA (siRNA) fragments produced by the dicer enzyme in the eukaryotic pathway identified by Hamilton et. al. (1999) and Elbashir et. al. (2001a). This collection of short interfering RNA duplexes was further purified and a sample characterized by polyacrylamide gel electrophoresis to determine the integrity and efficiency of duplex formation. The purity and quantity of the sample was then determined by spectrophotometry at a wavelength of 250 nanometers, and unused sample retained for further use by storage at ~20° C.

Insect diet was prepared essentially according to Pleau et al. (2002), with the following modifications. 9.4 grams of SERVA agar was dispensed into 540 milliliters of purified water and agitated until the agar was thoroughly distributed. The water/agar mixture was heated to boiling to completely dissolve the agar, and then poured into a WARING blender. The blender was maintained at low speed while 62.7 grams of BIO-SERV DIET mix (F9757), 3.75 grams lyophilized corn root, 1.25 milliliters of green food coloring, and 0.6 milliliters of formalin was added to the hot agar mixture. The mixture was then adjusted to pH 9.0 with the addition of a 10% potassium hydroxide stock solution. The approximately 600 milliliter volume of liquid diet was continually mixed at high speed and maintained at from about 48° C. to about 60° C. using a sterilized NALGENE coated magnetic stir bar on a magnetic stirring hot plate while being dispensed in aliquots of 200 microliters into each well of FALCON 96-well round bottom microtiter plates. The diet in the plates was allowed to solidify and air dry in a sterile biohood for about ten minutes.

Thirty (30) microliter volumes of test samples containing either control reagents or double stranded RNA in varying quantities was overlayed onto the surface of the insect diet in each well using a micro-pipettor repeater. Insect diet was allowed to stand in a sterile biohood for up to one half hour after application of test samples to allow the reagents to diffuse into the diet and to allow the surface of the diet to dry. One WCR neonate larva was deposited to each well with a fine paintbrush. Plates were then sealed with MYLAR and ventilated using an insect pin. 12-72 insect larvae were tested per dose depending on the design of the assay. The bioassay plates were incubated at 27° C., 60% relative humidity in complete darkness for 12-14 days. The number of surviving larvae per dose was recorded at the 12-14 day time point. Larval mass was determined using a suitable microbalance for each surviving larva. Data was analyzed using JMP®4 statistical software (SAS Institute, 1995) and a full factorial ANOVA was conducted with a Dunnet's test to look for treatment effects compared to the untreated control (P<0.05). A Tukey-Kramer post hoc test was performed to compare all pairs of the treatments (P<0.05). The results of the CRW larvae feeding assays exhibited significant growth inhibition and mortality compared to controls as explained below.

Example 3

Results of Insect Feeding Bioassays

Artificial diet sufficient for rearing corn rootworm larvae was prepared by applying samples of double stranded RNA sequences identified as described in Example 1 using bioassays carried out as described in Example 2. Corn rootworm larvae were typically allowed to feed on the diet for twelve days and mortality and stunting monitored in comparison to rootworms allowed to feed only on negative and positive control diets. The results of the studies confirmed significant levels (p<0.05) of larval stunting and/or mortality using dsRNAs containing portions sequences homologous to a variety of different gene classes. The sequences and vectors yielding significant stunting and/or mortality and the corresponding SEQ ID NO for the sequence expressed as a dsRNA are given in Tables 1-5 below.

TABLE 1 dsRNA Constructs Demonstrating Significant Stunting and/or Mortality in Effect in Insect Feeding Bioassays with Southern Corn Rootworm or Western Corn Rootworm

| Vector | Sequence Expressed as dsRNA | SEQ ID NO |
|---|---|---|
| RNAi-pIC17553:001 | Apple | 697 |
| RNAi-pIC17504:049 | EST Full Length V-ATPase | 695 |
| RNAi-pIC17554:001 | Rpl 9 | 698 |
| RNAi-pIC17555:001 | Rpl 19 | 699 |
| RNAi-pIC17504:050 | Section 6.0 V-ATPase | 711 |
| RNAi-pIC19514:001 | WCR mRNA capping enzyme LIB5496-028-A1-M1-A7 | 696 |
| RNAi-pIC17552:003 | LIB5462-042-A1-M1-H10 Dv.6__CG9355 DUSKY STRUCTURAL CONSTITUENT OF CUTICLE | 700 |
| RNAi-pIC17546:003 | LIB5462-091-A1-M1-G3 Dv.1__CG6217 KNICKKOPF UNK | 701 |
| RNAi-pIC17546:001 | Dv.1__CG6217 | 1 |
| RNAi-pIC17549:001 | Dv.4__CG1435 | 4 |
| RNAi-pIC17550:001 | LIB5444-065-A1-M1-D5 Dv.5__cg1915__1 | 5 |
| RNAi-pIC17551:001 | LIB5462-012-A1-M2-B2 Dv.5__cg1915__2 | 703 |
| RNAi-pIC17552:001 | Dv.6__CG9355 | 6 |
| RNAi-pMON78412:002 | Dv.7__CG3416; putative Mov34:CG3416 ortholog | 10 |
| RNAi-pMON96172:002 | Dv.8__CG1088; putative vacuolar H+ATPase E subunit: CG1088 ortholog | 14 |
| RNAi-pMON96168:002 | Dv.9__CG2331; putative ATPase activity: CG2331 ortholog | 18 |
| RNAi-pMON78424:002 | Dv.10__CG6141; putative ribosomal protein L9: CG6141 ortholog | 22 |
| RNAi-pMON78425:001 | Dv.11__CG2746 | 26 |
| RNAi-pMON78444:002 | Dv.12__CG1341; putative proteasome regulatory particle, rpt1: CG1341 ortholog | 30 |
| RNAi-pMON78416:002 | Dv.13__CG11276; putative ribosomal protein S4: CG11276 ortholog | 34 |
| RNAi-pMON78434:001 | Dv.14__CG17927__2; putative myosin heavy chain: CG17927 ortholog | 38 |
| RNAi-pMON78439:001 | Dv.16__CG5394; putative glutamyl-prolyl-tRNA synthetase: CG5394 ortholog | 46 |
| RNAi-pMON78438:001 | Dv.17__CG10149; putative proteasome p44.5 subunit, rpn6: CG10149 ortholog | 50 |
| RNAi-pMON78435:002 | Dv.18__CG1404; putative RAN small monomeric GTPase: CG1404 ortholog | 54 |
| RNAi-pMON78449:002 | Dv.19__CG18174; putative proteasome regulatory particle, lid subcomplex, rpn11: CG18174 ortholog | 58 |
| RNAi-pMON78419:001 | Dv.20__CG3180__1; putative DNA-directed RNA polymerase II: CG3180 ortholog | 62 |
| RNAi-pMON78440:002 | Dv20__CG3180__2; putative DNA-directed RNA polymerase II: CG3180 ortholog | 706 |
| RNAi-pMON78420:001 | Dv.21__CG3320; putative Rab1: CG3320 ortholog | 70 |
| RNAi-pMON78410:002 | Dv.22__CG3395; putative Ribosomal protein S9: CG3395 ortholog | 74 |
| RNAi-pMON78422:001 | Dv.23__CG7269; putative helicase: CG7269 ortholog | 78 |
| RNAi-pMON78423:001 | Dv.25__CG9012; putative Clathrin heavy chain: CG9012 ortholog | 86 |
| RNAi-pMON78414:006 | DV.26 sec1 ~5' half of EST | 710 |
| RNAi-pMON78414:001 | Dv.26__CG9261; putative sodium/potassium-exchanging ATPase: CG9261 ortholog | 90 |
| RNAi-pMON78413:001 | Dv.27__CG12052; putative RNA polymerase II transcription factor: CG12052 ortholog. | 94 |
| RNAi-pMON78427:001 | Dv.35__CG3762; putative Vha68-2: CG3762 ortholog. | 126 |
| RNAi-pMON97122:001 | C1__Dv.35; putative Vha68-2: CG3762 ortholog; concatamer | 713 |
| RNAi-pMON97127:001 | C2__Dv.35; putative Vha68-2: CG3762 ortholog; concatamer | 714 |

TABLE 1-continued dsRNA Constructs Demonstrating Significant Stunting and/or Mortality in Effect in Insect Feeding Bioassays with Southern Corn Rootworm or Western Corn Rootworm

| Vector | Sequence Expressed as dsRNA | SEQ ID NO |
|---|---|---|
| RNAi-pMON97125:001 | C3_Dv.35; putative Vha68-2: CG3762 ortholog; concatamer | 715 |
| RNAi-pMON78441:001 | Dv.39_CG9078; putative sphingolipid delta-4 desaturase; stearoyl-CoA 9-desaturase: CG9078 ortholog | 142 |
| RNAi-pMON97114:001 | Dv.41_CG2637; Female sterile Ketel; involved in protein-nucleus import: CG2637 ortholog | 150 |
| RNAi-pMON97140:001 | Dv.44_CG1244; Putative nucleic acid binding activity: CG1244 ortholog | 162 |
| RNAi-pMON78429:001 | Dv.46_CG10689; putative RNA helicase: CG10689 ortholog. | 170 |
| RNAi-pMON78432:001 | Dv.48_CG33196; putative transmembrane receptor protein tyrosine kinase: CG33196 ortholog | 178 |
| RNAi-pMON78428:001 | Dv.49_CG8055_1; putative binding, carrier activity: CG8055_1 ortholog | 182 |
| RNAi-pMON78428:003 | Dv.49_CG8055_1; putative binding, carrier activity: CG8055_1 ortholog Free region selected from DV.49 | 704 |
| RNAi-pMON78426:001 | Dv.50_CG10110_1; putative Cleavage and polyadenylation specificity factor: CG10110_1 ortholog | 186 |
| RNAi-pMON96185:001 | Dv.55_CG5931; putative splicing factor activity, RNA helicase activity: CG5931 ortholog | 202 |
| RNAi-pMON78442:001 | Dv.57_CG2968 putative hydrogen-exporting ATPase: CG2968 ortholog | 206 |
| RNAi-pMON78431:001 | Dv.58_CG1751; putative signal peptidase: CG1751 ortholog | 210 |
| RNAi-pMON96177:001 | Dv.61_CG3725_1; putative Calcium ATPase: CG3725 ortholog | 222 |
| RNAi-pMON96183:001 | Dv.62_CG3612; putative bellwether: CG3612 ortholog | 230 |
| RNAi-pMON96180:002 | Dv.65_CG7033; putative chaperone activity: CG7033 ortholog | 242 |
| RNAi-pMON96176:001 | Dv.66_CG32019; putative bent: CG32019 ortholog | 246 |
| RNAi-pMON96170:002 | Dv.67_CG16916; putative endopeptidase activity: CG16916 ortholog | 250 |
| RNAi-pMON96166:001 | Dv.70_CG5771; putative Rab-protein 11: CG5771 ortholog | 258 |
| RNAi-pMON96179:001 | Dv.72_CG6831; putative rhea: CG6831 ortholog | 266 |
| RNAi-pMON96186:001 | Dv.73_CG10119; putative Lamin C: CG10119 ortholog | 270 |
| RNAi-pMON96160:002 | Dv.74_CG6375; putative pitchoune: CG6375 ortholog | 274 |
| RNAi-pMON97137:001 | Dv.77_CG4214; putative Syntaxin 5; involved in intracellular protein transport: CG4214 ortholog | 286 |
| RNAi-pMON96167:001 | Dv.82_CG8264; putative Bx42: CG8264 ortholog | 302 |
| RNAi-pMON96171:001 | Dv.83_CG11397; putative gluon: CG11397 ortholog | 306 |
| RNAi-pMON96187:003 | Dv.85_CG4494; putative protein binding activity: CG4494 ortholog | 314 |
| RNAi-pMON96174:001 | Dv.86_CG5055; putative bazooka: CG5055 ortholog | 318 |
| RNAi-pMON97126:001 | Dv.88_CG8756; function unknown; contains chitin binding domain: CG8756 ortholog | 326 |
| RNAi-pMON97130:001 | Dv.93_CG8515; putative structural constituent of cuticle; contains chitin binding domain: CG8515 ortholog | 342 |
| RNAi-pMON97109:001 | Dv.99_CG2446; Unknown; lethal in *Drosophila* & low homology with human: CG2446 ortholog | 366 |
| RNAi-pMON97111:001 | Dv.105_CG1250_1; GTPase activator, involved in intracellular protein transport: CG1250 ortholog | 390 |
| RNAi-pMON97112:001 | Dv.105_CG1250_2; GTPase activator, involved in intracellular protein transport: CG1250 ortholog | 394 |

TABLE 1-continued dsRNA Constructs Demonstrating Significant Stunting and/or Mortality in Effect
in Insect Feeding Bioassays with Southern Corn Rootworm or Western Corn Rootworm

| Vector | Sequence Expressed as dsRNA | SEQ ID NO |
|---|---|---|
| RNAi-pMON97107:001 | Dv.107__CG14813; COPI vesicle coat; involved in Golgi to ER intracellular protein transport: CG14813 ortholog | 398 |
| RNAi-pMON97115:001 | Dv.108__CG17248; n-synaptobrevin; involved in intracellular protein transport: CG17248 ortholog | 402 |
| RNAi-pMON97133:001 | Dv.113; function unknown; WCR unique sequence | 422 |
| RNAi-pMON97121:001 | Dv.122__CG3164; putative ATP-binding cassette transporter activity: CG3164 ortholog | 454 |
| RNAi-pMON97134:001 | Dv.127; function unknown; no homology with human | 470 |
| RNAi-pMON97171:001 | Dv.146; function unknown, WCR unique sequence | 514 |
| RNAi-pMON97166:001 | Dv.147; function unknown, WCR unique sequence | 518 |
| RNAi-pMON97167:001 | Dv.149; function unknown, WCR unique sequence | 526 |
| RNAi-pMON97169:001 | Dv.155; function unknown, WCR unique sequence | 550 |
| RNAi-pMON97173:001 | Dv.162; function unknown, WCR unique sequence | 578 |
| RNAi-pMON97170:001 | Dv.170; function unknown, WCR unique sequence | 610 |

TABLE 2 dsRNA Constructs Causing Significant Stunting Levels in Feeding Bioassays with
Western Corn Rootworm (WCR) Larvae

| Vector | Sequence Expressed as dsRNA |
|---|---|
| RNAi-pIC17553:001 | Apple |
| RNAi-pIC17504:049 | EST Full Length V-ATPase |
| RNAi-pIC17554:001 | Rpl 9 |
| RNAi-pIC17555:001 | Rpl 19 |
| RNAi-pIC17504:050 | Section 6.0 V-ATPase |
| RNAi-pIC16005:001 | V-ATPase D subunit 1 |
| RNAi-pIC19514:001 | WCR mRNA capping enzyme LIB5496-028-A1-M1-A7 |
| RNAi-pIC17546:001 | Dv.1__CG6217 |
| RNAi-pIC17549:001 | Dv.4__CG1435 |
| RNAi-pIC17551:001 | LIB5462-012-A1-M2-B2 Dv.5__cg1915__2 |
| RNAi-pIC17552:001 | Dv.6__CG9355 |
| RNAi-pMON78412:001 | Dv.7__CG3416 |
| RNAi-pMON78412:002 | Dv.7__CG3416; putative Mov34:CG3416 ortholog |
| RNAi-pMON96172:002 | Dv.8__CG1088; putative vacuolar H+ATPase E subunit: CG1088 ortholog |
| RNAi-pMON96168:002 | Dv.9__CG2331; putative ATPase activity: CG2331 ortholog |
| RNAi-pMON78424:002 | Dv.10__CG6141; putative ribosomal protein L9: CG6141 ortholog |
| RNAi-pMON78425:001 | Dv.11__CG2746 |
| RNAi-pMON78444:002 | Dv.12__CG1341; putative proteasome regulatory particle, rpt1: CG1341 ortholog |
| RNAi-pMON78416:002 | Dv.13__CG11276; putative ribosomal protein S4: CG11276 ortholog |
| RNAi-pMON78434:001 | Dv.14__CG17927__2; putative myosin heavy chain: CG17927 ortholog |
| RNAi-pMON78439:001 | Dv.16__CG5394; putative glutamyl-prolyl-tRNA synthetase: CG5394 ortholog |
| RNAi-pMON78435:002 | Dv.18__CG1404; putative RAN small monomeric GTPase: CG1404 ortholog |
| RNAi-pMON78449:002 | Dv.19__CG18174; putative proteasome regulatory particle, lid subcomplex, rpn11: CG18174 ortholog |
| RNAi-pMON78440:002 | Dv.20__CG3180__2; putative DNA-directed RNA polymerase II: CG3180 ortholog |
| RNAi-pMON78420:002 | Dv.21__CG3320; putative Rab1: CG3320 ortholog |
| RNAi-pMON78410:001 | Dv.22__CG3395; putative Ribosomal protein S9: CG3395 ortholog |
| RNAi-pMON78422:001 | Dv.23__CG7269; putative helicase: CG7269 ortholog |
| RNAi-pMON78423:001 | Dv.25__CG9012; putative Clathrin heavy chain: CG9012 ortholog |
| RNAi-pMON78414:001 | Dv.26__CG9261; putative sodium/potassium-exchanging ATPase: CG9261 ortholog |

TABLE 2-continued dsRNA Constructs Causing Significant Stunting Levels in Feeding Bioassays with Western Corn Rootworm (WCR) Larvae

| Vector | Sequence Expressed as dsRNA |
| --- | --- |
| RNAi-pMON78413:001 | Dv.27_CG12052; putative RNA polymerase II transcription factor: CG12052 ortholog. |
| RNAi-pMON97122:001 | C1_Dv.35; putative Vha68-2: CG3762 ortholog; concatamer |
| RNAi-pMON97127:001 | C2_Dv.35; putative Vha68-2: CG3762 ortholog; concatamer |
| RNAi-pMON97125:001 | C3_Dv.35; putative Vha68-2: CG3762 ortholog; concatamer |
| RNAi-pMON78427:007 | Dv.35_CG3762; putative Vha68-2: CG3762 ortholog. |
| RNAi-pMON78441:001 | Dv.39_CG9078; putative sphingolipid delta-4 desaturase; stearoyl-CoA 9-desaturase: CG9078 ortholog |
| RNAi-pMON97114:001 | Dv.41_CG2637; Female sterile Ketel; involved in protein-nucleus import: CG2637 ortholog |
| RNAi-pMON78429:001 | Dv.46_CG10689; putative RNA helicase: CG10689 ortholog. |
| RNAi-pMON78432:001 | Dv.48_CG33196; putative transmembrane receptor protein tyrosine kinase: CG33196 ortholog |
| RNAi-pMON78428:001 | Dv.49_CG8055_1; putative binding, carrier activity: CG8055_1 ortholog |
| RNAi-pMON78428:003 | Dv.49_CG8055_1; putative binding, carrier activity: CG8055_1 ortholog Free region selected from DV.49 |
| RNAi-pMON78426:001 | Dv.50_CG10110_1; putative Cleavage and polyadenylation specificity factor: CG10110_1 ortholog |
| RNAi-pMON96185:001 | Dv.55_CG5931; putative splicing factor activity, RNA helicase activity: CG5931 ortholog |
| RNAi-pMON78442:001 | Dv.57_CG2968; putative hydrogen-exporting ATPase: CG2968 ortholog |
| RNAi-pMON78431:001 | Dv.58_CG1751; putative signal peptidase: CG1751 ortholog |
| RNAi-pMON96177:001 | Dv.61_CG3725_1; putative Calcium ATPase: CG3725 ortholog |
| RNAi-pMON96182:001 | Dv.61_CG3725_2; putative Calcium ATPase: CG3725 ortholog |
| RNAi-pMON96183:001 | Dv.62_CG3612; putative bellwether: CG3612 ortholog |
| RNAi-pMON96180:002 | Dv.65_CG7033; putative chaperone activity: CG7033 ortholog |
| RNAi-pMON96180:001 | Dv.65_CG7033; putative chaperone activity: CG7033 ortholog |
| RNAi-pMON96176:001 | Dv.66_CG32019; putative bent: CG32019 ortholog |
| RNAi-pMON96170:002 | Dv.67_CG16916; putative endopeptidase activity: CG16916 ortholog |
| RNAi-pMON96166:001 | Dv.70_CG5771; putative Rab-protein 11: CG5771 ortholog |
| RNAi-pMON96179:001 | Dv.72_CG6831; putative rhea: CG6831 ortholog |
| RNAi-pMON96186:001 | Dv.73_CG10119; putative Lamin C: CG10119 ortholog |
| RNAi-pMON96160:002 | Dv.74_CG6375; putative pitchoune: CG6375 ortholog |
| RNAi-pMON96160:001 | Dv.74_CG6375; putative pitchoune: CG6375 ortholog |
| RNAi-pMON97137:002 | Dv.77_CG4214; putative Syntaxin 5; involved in intracellular protein transport: CG4214 ortholog |
| RNAi-pMON96167:001 | Dv.82_CG8264; putative Bx42: CG8264 ortholog |
| RNAi-pMON96171:001 | Dv.83_CG11397; putative gluon: CG11397 ortholog |
| RNAi-pMON96187:003 | Dv.85_CG4494; putative protein binding activity: CG4494 ortholog |
| RNAi-pMON97126:001 | Dv.88_CG8756; function unknown; contains chitin binding domain: CG8756 ortholog |
| RNAi-pMON97109:001 | Dv.99_CG2446; Unknown; lethal in *Drosophila* & low homology with human: CG2446 ortholog |
| RNAi-pMON97111:001 | Dv.105_CG1250_1; GTPase activator, involved in intracellular protein transport: CG1250 ortholog |
| RNAi-pMON97107:001 | Dv.107_CG14813; COPI vesicle coat; involved in Golgi to ER intracellular protein transport: CG14813 ortholog |
| RNAi-pMON97115:001 | Dv.108_CG17248; n-synaptobrevin; involved in intracellular protein transport: CG17248 ortholog |
| RNAi-pMON97121:001 | Dv.122_CG3164; putative ATP-binding cassette transporter activity: CG3164 ortholog |
| RNAi-pMON97171:001 | Dv.146; function unknown, WCR unique sequence |
| RNAi-pMON97166:001 | Dv.147; function unknown, WCR unique sequence |
| RNAi-pMON97167:001 | Dv.149; function unknown, WCR unique sequence |
| RNAi-pMON97169:001 | Dv.155; function unknown, WCR unique sequence |
| RNAi-pMON97173:001 | Dv.162; function unknown, WCR unique sequence |
| RNAi-pMON97170:001 | Dv.170; function unknown, WCR unique sequence |

TABLE 3 dsRNA Constructs Causing Significant Mortality Levels in Feeding Bioassays with Western Corn Rootworm (WCR) Larvae

| Vector | Sequence Expressed as dsRNA |
| --- | --- |
| RNAi-pIC17553:001 | Apple |
| RNAi-pIC17504:049 | EST Full Length V-ATPase |
| RNAi-pIC17555:001 | Rpl 19 |
| RNAi-pIC17554:001 | Rpl 9 |

TABLE 3-continued dsRNA Constructs Causing Significant Mortality Levels in Feeding Bioassays with Western Corn Rootworm (WCR) Larvae

| Vector | Sequence Expressed as dsRNA |
|---|---|
| RNAi-pIC17504:050 | Section 6.0 V-ATPase |
| RNAi-pIC17504:054 | V-ATPase subunit 2 sequence from *Diabrotica virgifera virgifera* Full EST sequence serving as positive control |
| RNAi-pIC19514:001 | WCR mRNA capping enzyme LIB5496-028-A1-M1-A7 |
| RNAi-pIC17546:001 | Dv.1__CG6217 |
| RNAi-pIC17549:001 | Dv.4__CG1435 |
| RNAi-pIC17550:001 | LIB5444-065-A1-M1-D5 Dv.5__cg1915__1 |
| RNAi-pMON78412:002 | Dv.7__CG3416; putative Mov34:CG3416 ortholog |
| RNAi-pMON96172:001 | Dv.8__CG1088; putative vacuolar H+ATPase E subunit: CG1088 ortholog |
| RNAi-pMON96168:001 | Dv.9__CG2331; putative ATPase activity: CG2331 ortholog |
| RNAi-pMON78424:002 | Dv.10__CG6141; putative ribosomal protein L9: CG6141 ortholog |
| RNAi-pMON78425:001 | Dv.11__CG2746 |
| RNAi-pMON78444:001 | Dv.12__CG1341; putative proteasome regulatory particle, rpt1: CG1341 ortholog |
| RNAi-pMON78416:002 | Dv.13__CG11276; putative ribosomal protein S4: CG11276 ortholog |
| RNAi-pMON78434:001 | Dv.14__CG17927__2; putative myosin heavy chain: CG17927 ortholog |
| RNAi-pMON78435:001 | Dv.18__CG1404; putative RAN small monomeric GTPase: CG1404 ortholog |
| RNAi-pMON78449:001 | Dv.19__CG18174; putative proteasome regulatory particle, lid subcomplex, rpn11: CG18174 ortholog |
| RNAi-pMON78440:001 | Dv.20__CG3180; putative DNA-directed RNA polymerase II: CG3180 ortholog |
| RNAi-pMON78420:001 | Dv.21__CG3320; putative Rab1: CG3320 ortholog |
| RNAi-pMON78410:001 | Dv.22__CG3395; putative Ribosomal protein S9: CG3395 ortholog |
| RNAi-pMON78422:001 | Dv.23__CG7269; putative helicase: CG7269 ortholog |
| RNAi-pMON78414:006 | Dv.26 sec1 ~5' half of EST |
| RNAi-pMON78414:001 | Dv.26__CG9261; putative sodium/potassium-exchanging ATPase: CG9261 ortholog |
| RNAi-pMON97122:001 | C1__Dv.35; putative Vha68-2: CG3762 ortholog; concatamer |
| RNAi-pMON97127:001 | C2__Dv.35; putative Vha68-2: CG3762 ortholog; concatamer |
| RNAi-pMON97125:001 | C3__Dv.35; putative Vha68-2: CG3762 ortholog; concatamer |
| RNAi-pMON78427:001 | Dv.35__CG3762; putative Vha68-2: CG3762 ortholog. |
| RNAi-pMON97114:001 | Dv.41__CG2637; Female sterile Ketel; involved in protein-nucleus import: CG2637 ortholog |
| RNAi-pMON97140:001 | Dv.44__CG1244; Putative nucleic acid binding activity: CG1244 ortholog |
| RNAi-pMON78429:001 | Dv.46__CG10689; putative RNA helicase: CG10689 ortholog. |
| RNAi-pMON78428:001 | Dv.49__CG8055__1; putative binding, carrier activity: CG8055__1 ortholog |
| RNAi-pMON78428:003 | Dv.49__CG8055__1; putative binding, carrier activity: CG8055__1 ortholog Free region selected from DV.49 |
| RNAi-pMON78426:001 | Dv.50__CG10110__1; putative Cleavage and polyadenylation specificity factor: CG10110__1 ortholog |
| RNAi-pMON96185:001 | Dv.55__CG5931; putative splicing factor activity, RNA helicase activity: CG5931 ortholog |
| RNAi-pMON78431:001 | Dv.58__CG1751; putative signal peptidase: CG1751 ortholog |
| RNAi-pMON96177:001 | Dv.61__CG3725__1; putative Calcium ATPase: CG3725 ortholog |
| RNAi-pMON96182:001 | Dv.61__CG3725__2; putative Calcium ATPase: CG3725 ortholog |
| RNAi-pMON96180:001 | Dv.65__CG7033; putative chaperone activity: CG7033 ortholog |
| RNAi-pMON96176:001 | Dv.66__CG32019; putative bent: CG32019 ortholog |
| RNAi-pMON96170:001 | Dv.67__CG16916; putative endopeptidase activity: CG16916 ortholog |
| RNAi-pMON96166:001 | Dv.70__CG5771; putative Rab-protein 11: CG5771 ortholog |
| RNAi-pMON96160:001 | Dv.74__CG6375; putative pitchoune: CG6375 ortholog |
| RNAi-pMON97137:001 | Dv.77__CG4214; putative Syntaxin 5; involved in intracellular protein transport: CG4214 ortholog |
| RNAi-pMON96167:001 | Dv.82__CG8264; putative Bx42: CG8264 ortholog |
| RNAi-pMON96187:002 | Dv.85__CG4494; putative protein binding activity: CG4494 ortholog |
| RNAi-pMON97126:001 | Dv.88__CG8756; function unknown; contains chitin binding domain: CG8756 ortholog |
| RNAi-pMON97130:001 | Dv.93__CG8515; putative structural constituent of cuticle; contains chitin binding domain: CG8515 ortholog |
| RNAi-pMON97111:001 | Dv.105__CG1250__1; GTPase activator, involved in intracellular protein transport: CG1250 ortholog |
| RNAi-pMON97107:001 | Dv.107__CG14813; COPI vesicle coat; involved in Golgi to ER intracellular protein transport: CG14813 ortholog |
| RNAi-pMON97115:001 | Dv.108__CG17248; n-synaptobrevin; involved in intracellular protein transport: CG17248 ortholog |
| RNAi-pMON97133:001 | Dv.113; function unknown; WCR unique sequence |

TABLE 3-continued

| dsRNA Constructs Causing Significant Mortality Levels in Feeding Bioassays with Western Corn Rootworm (WCR) Larvae | |
|---|---|
| Vector | Sequence Expressed as dsRNA |
| RNAi-pMON97121:001 | Dv.122_CG3164; putative ATP-binding cassette transporter activity: CG3164 ortholog |
| RNAi-pMON97134:001 | Dv.127; function unknown; no homology with human |

TABLE 4

| dsRNA Constructs Causing Significant Stunting Levels in Feeding Bioassays with Southern Corn Rootworm (SCR) Larvae | |
|---|---|
| Vector | Sequence Expressed as dsRNA |
| RNAi-pMON96172:001 | Dv8_CG1088; putative vacuolar H+ATPase E subunit: CG1088 ortholog |
| RNAi-pMON96168:001 | Dv9_CG2331; putative ATPase activity: CG2331 ortholog |
| RNAi-pMON78424:001 | Dv.10_CG6141 |
| RNAi-pMON96155:002 | Dv.10_CG6141; putative ribosomal protein L9: CG6141 ortholog. |
| RNAi-pMON78425:001 | Dv.11_CG2746 |
| RNAi-pMON96158:002 | Dv.11_CG2746; putative Ribosomal protein L19: CG2746 ortholog. |
| RNAi-pMON78416:001 | Dv.13_CG11276 |
| RNAi-pMON78434:001 | Dv.14_CG17927_2; putative myosin heavy chain: CG17927 ortholog |
| RNAi-pMON78435:001 | Dv.18_CG1404; putative RAN small monomeric GTPase: CG1404 ortholog |
| RNAi-pMON78449:001 | Dv.19_CG18174; putative proteasome regulatory particle, lid subcomplex, rpn11: CG18174 ortholog |
| RNAi-pMON78419:001 | Dv.20_CG3180 |
| RNAi-pMON78420:001 | Dv.21_CG3320; putative Rab1: CG3320 ortholog |
| RNAi-pMON78414:001 | Dv.26_CG9261; putative sodium/potassium-exchanging ATPase: CG9261 ortholog |
| RNAi-pMON97122:001 | C1_Dv35; putative Vha68-2: CG3762 ortholog; concatamer |
| RNAi-pMON97125:001 | C3_Dv35; putative Vha68-2: CG3762 ortholog; concatamer |
| RNAi-pMON78427:008 | Dv.35_CG3762; putative Vha68-2: CG3762 ortholog. |
| RNAi-pMON78428:001 | Dv.49_CG8055_1; putative binding, carrier activity: CG8055_1 ortholog |
| RNAi-pMON78442:001 | Dv.57_CG2968; putative hydrogen-exporting ATPase: CG2968 ortholog |
| RNAi-pMON96177:001 | Dv61_CG3725_1; putative Calcium ATPase: CG3725 ortholog |
| RNAi-pMON96166:001 | Dv70_CG5771; putative Rab-protein 11: CG5771 ortholog |
| RNAi-pMON97126:001 | Dv88_CG8756; function unknown; contains chitin binding domain: CG8756 ortholog |
| RNAi-pMON97111:001 | Dv105_CG1250_1; GTPase activator, involved in intracellular protein transport: CG1250 ortholog |
| RNAi-pMON97112:001 | Dv105_CG1250_2; GTPase activator, involved in intracellular protein transport: CG1250 ortholog |
| RNAi-pMON97107:001 | Dv107_CG14813; COPI vesicle coat; involved in Golgi to ER intracellular protein transport: CG14813 ortholog |
| RNAi-pMON97121:001 | Dv122_CG3164; putative ATP-binding cassette transporter activity: CG3164 ortholog |

TABLE 5

| dsRNA Constructs Causing Significant Mortality Levels in Feeding Bioassays with Southern Corn Rootworm (SCR) Larvae | |
|---|---|
| Vector | Sequence Expressed as dsRNA |
| RNAi-pIC17546:003 | LIB5462-091-A1-M1-G3 Dv1_CG6217 KNICKKOPF UNK |
| RNAi-pIC17504:055 | V-ATPase subunit 2 sequence from *Diabrotica virgifera virgifera* |
| | Full EST sequence serving as positive control |
| RNAi-pMON96155:001 | Dv.10_CG6141; putative ribosomal protein L9: CG6141 ortholog |
| RNAi-pMON96158:001 | Dv.11_CG2746; putative Ribosomal protein L19: CG2746 ortholog |
| RNAi-pMON78416:001 | Dv.13_CG11276 |

TABLE 5-continued

| dsRNA Constructs Causing Significant Mortality Levels in Feeding Bioassays with Southern Corn Rootworm (SCR) Larvae | |
|---|---|
| Vector | Sequence Expressed as dsRNA |
| RNAi-pMON96154:003 | Dv.14_CG17927; putative myosin heavy chain: CG17927 ortholog; cells grown in S Complete medium. |
| RNAi-pMON78438:001 | Dv.17_CG10149; putative proteasome p44.5 subunit, rpn6: CG10149 ortholog |
| RNAi-pMON78449:001 | Dv.19_CG18174; putative proteasome regulatory particle, lid subcomplex, rpn11: CG18174 ortholog |
| RNAi-pMON78440:001 | Dv.20_CG3180; putative DNA-directed RNA polymerase II: CG3180 ortholog |
| RNAi-pMON96156:001 | Dv.20_CG3180; putative RNA polymerase II 140 kD subunit: CG3180 ortholog |
| RNAi-pMON78420:001 | Dv.21_CG3320; putative Rab1: CG3320 ortholog |
| RNAi-pMON78427:006 | Dv.35_CG3762; putative Vha68-2: CG3762 ortholog. |
| RNAi-pMON78428:001 | Dv.49_CG8055_1; putative binding, carrier activity: CG8055_1 ortholog |
| RNAi-pMON96177:001 | Dv61_CG3725_1; putative Calcium ATPase: CG3725 ortholog |
| RNAi-pMON96166:001 | Dv70_CG5771; putative Rab-protein 11: CG5771 ortholog |
| RNAi-pMON96174:001 | Dv86_CG5055; putative bazooka: CG5055 ortholog |
| RNAi-pMON97111:001 | Dv105_CG1250_1; GTPase activator, involved in intracellular protein transport: CG1250 ortholog |
| RNAi-pMON97107:001 | Dv107_CG14813; COPI vesicle coat; involved in Golgi to ER intracellular protein transport: CG14813 ortholog |

Example 4

Transgenic Plant Transformation and Bioassays

Briefly, the sequence encoding a dsRNA construct as described above is linked at the 5' end to a sequence consisting of a 35S promoter operably linked to a maize hsp70 intron and at the 3' end to a Nos3' transcription termination and polyadenylation sequence. This expression cassette is placed downstream of a glyphosate selection cassette. These linked cassettes are then placed into an *Agrobacterium tumefaciens* plant transformation functional vector, used to transform maize tissue to glyphosate tolerance, and events selected and transferred to soil. $R_0$ plant roots are fed to western corn rootworm larvae (WCR, *Diabrotica virgifera*). Transgenic corn roots are handed-off in Petri dishes with MS0D medium containing antibiotics and glyphosate for in vitro selection. Two WCR larvae are infested per root in each dish with a fine tip paintbrush. The dishes are sealed with Parafilm to prevent the larvae from escaping. The assays are placed into a 27° C., 60% RH Percival incubator in complete darkness. Contamination and larval quality are monitored. After six days of feeding on root tissue, the larvae are transferred to WCR diet in a 96 well plate. The larvae are allowed to feed on the diet for eight days making the full assay fourteen days long. Larval mass and survivorship are recorded for analysis. A one-way ANOVA analysis and a Dunnett's test is performed on the larval mass data to look for statistical significance compared to an untransformed negative control. WCR larvae stunting is measured after feeding on two events and compared to growth of larvae fed on negative control plants.

Transgenic corn plants ($R_0$) generated are planted into 10-inch pots containing Metromix soil after reaching an appropriate size. When plants reach the V4 growth stage, approximately 1000 Western corn rootworm (WCR, *Diabrotica virgifera*) eggs are infested into the root zone. Non-transgenic corn of the same genotype is infested at a similar growth stage to serve as a negative control. Eggs are pre-incubated so hatch occurs within 24 hours of infestation. Larvae are allowed to feed on the root systems for 3 weeks. Plants are removed from the soil and washed so that the roots can be evaluated for larval feeding. Root damage is rated using a Node Injury Scale (NIS) to score the level of damage where a 0 indicates no damage, a 1 indicates that one node of roots is pruned to within 1.5 inches, a 2 indicates that 2 nodes are pruned, while a 3 indicates that 3 nodes are pruned. Because the plants being used for evaluation are directly out of tissue culture after transformation and because transformation events are unique, only a single plant is evaluated per event at this time. The plants in the assay that present signs or symptoms of larval feeding indicate that a successful infestation is obtained. Negative control plant roots are moderately to severely damaged averaging whereas roots of the transgenic plants provide substantial control of larval feeding, with about 0.2 or less on the Node Injury Scale.

Example 5

Implementing Insect Pest Gene Suppression Using A ta-siRNA Mediated Silencing Method An alternative method to silence genes in a plant pest uses the recently discovered class of trans-acting small interfering RNA (ta-siRNA) (Dalmay et al., 2000; Mourrain et al., 2000; Peragine et al, 2004; Vazquez et al, 2004). ta-siRNA are derived from single strand RNA transcripts that are targeted by naturally occurring miRNA within the cell. Methods for using microRNA to trigger ta-siRNA for gene silencing in plants are described in U.S. Provisional Patent Application Ser. No. 60/643,136 (Carrington et al. 2004), incorporated herein by reference in its entirety. At least one pest specific miRNA expressed in gut epithelial cells of corn rootworm larvae is identified. This pest specific miRNA is then used to identify at least one target RNA transcript sequence complementary to the miRNA that is expressed in the cell. The corresponding target sequence is a short sequence of no more than 21 contiguous nucleotides that, when part of a RNA transcript and contacted by its corresponding miRNA in a cell type with a functional RNAi pathway, leads to slicer-mediated cleavage of said transcript. Once miRNA target sequences are identified, at least one miRNA target sequence is fused to a second sequence that corresponds to part of a pest gene that is to be silenced using this method. For example, the miRNA target sequence(s) is fused to any of SEQ ID NO:1 through SEQ ID NO:906, or a fragment thereof, such as a sequence of the corn rootworm vacuolar ATPase (V-ATPase) gene. The miRNA target sequence can be placed at the 5' end, the 3' end, or embedded in the middle of the target sequence. It may be preferable to use multiple miRNA target sequences corresponding to multiple miRNA genes, or use the same miRNA target sequence multiple times in the chimera of the miRNA target sequence and the target gene sequence. The target gene sequence can be of any length, with a minimum of 21 bp.

The chimera of the miRNA target sequence(s) and the target gene sequence is expressed in plant cells using any of a number of appropriate promoter and other transcription regulatory elements, as long as the transcription occurs in cell types subject to being provided in the diet of the pest, e.g. corn roots for control of corn rootworm.

This method may have the additional advantage of delivering longer RNA molecules to the target pest. Typically, dsRNAs produced in plants are rapidly processed by Dicer into short RNA's that may not be effective when fed exogenously to some pests. In this method, a single strand transcript is produced in the plant cell, taken up by the pest, and converted into a dsRNA in the pest cell where it is then processed into ta-siRNA capable of post-transcriptionally silencing one or more genes in one or more target pests.

Example 6

Method for Providing a DNA Sequence for dsRNA-Mediated Gene Silencing

This example illustrates a method for providing a DNA sequence for dsRNA-mediated gene silencing. More specifically, this example describes selection of an improved DNA useful in dsRNA-mediated gene silencing by (a) selecting from a target gene an initial DNA sequence including more than 21 contiguous nucleotides; (b) identifying at least one shorter DNA sequence derived from regions of the initial DNA sequence consisting of regions predicted to not generate undesirable polypeptides and not exhibiting identity with known sequences such as homologs/orthologs, and (c) selecting a DNA sequence for dsRNA-mediated gene silencing that includes the at least one shorter DNA sequence. Undesirable polypeptides include, but are not limited to, polypeptides homologous to allergenic polypeptides and polypeptides homologous to known polypeptide toxins.

WCR V-ATPase has been demonstrated to function in corn rootworm feeding assays to test dsRNA mediated silencing as a means of controlling larval growth. A cDNA sequence from a target gene, such as vacuolar ATPase gene (V-ATPase) from Western corn rootworm (WCR) (*Diabrotica virgifera virgifera* LeConte), is selected for use as an initial DNA sequence. This initial DNA sequence can be screened to identify regions within which every contiguous fragment including at least 21 nucleotides matches fewer than 21 out of 21 contiguous nucleotides of known vertebrate sequences. Sequence segments that are greater than about 100 contiguous nucleotides free of such 21/21 hits are identified. Thus criteria including segment length, GC content, sequence, predicted function based on sequence or function of a corresponding gene in a model organism, and predicted secondary structure (e.g. Elbashir, et al., 2001b) may be used to select and design sequence(s) for use. Different combinations of these sequence segments are combined to construct chimeric DNA sequences for expression as dsRNA and use in insect feeding bioassays as described above.

Example 7

Additional Results of Insect Feeding Bioassays with Sequences Selected from EST Database This example illustrates additional sequences found to be effective in causing larval stunting and/or mortality when ingested by rootworm larvae as double stranded RNA sequences. Methods for rearing corn rootworm larvae, application of dsRNA, and insect bioassays are as described in Examples 1-3. The results of the studies confirmed significant levels ($p<0.05$) of larval stunting and/or mortality using dsRNAs containing portions of sequences homologous to a variety of different gene classes. The sequences and vectors yielding significant stunting and/or mortality and the corresponding SEQ ID NO for the sequence expressed as a dsRNA are given in Table 6 below. pMON98503, an exemplary binary vector used in corn transformation, contains the following elements between the right and left T-DNA borders for transfer into a plant cell: e35S-HSP70-DV49 (antisense orientation)-universal spacer-DV49 (sense orientation)-hsp17; ACT (promoter and intron)-CTP2 transit signal-CP4-NOS.: pMON98504, another exemplary binary vector used in corn transformation, contains the following elements between the right and left borders: e35S-HSP70-C1 (antisense orientation)-universal spacer-C1 (sense orientation)-hsp17; ACT (promoter and intron)-CTP2 transit signal-CP4-NOS.

TABLE 6

Additional dsRNA Constructs Demonstrating Significant Stunting and/or Mortality Effect in Insect Feeding Bioassays with Southern Corn Rootworm or Western Corn Rootworm

| Vector | Sequence Expressed as dsRNA | SEQ ID NO |
|---|---|---|
| pMON98356 | Dv164; function unknown, WCR unique sequence | 726 |
| pMON98354 | Dv172; function unknown, WCR unique sequence | 727 |
| pMON97191 | Dv189; function unknown, WCR unique sequence | 728 |
| pMON98359 | Dv200; function unknown, WCR unique sequence | 729 |
| pMON38880 | Dv207_F39H11.5; putative pbs-7, endopeptidase: F39H11.5 ortholog | 730 |
| pMON101054 | Dv208_F58F12_1; putative Mitochondrial F1F0-ATP synthase, subunit delta/ATP16: F58F12_1 ortholog | 731 |
| pMON98437 | Dv210_K11H12_2; putative rpl-15, structural constituent of ribosome: K11H12_2 ortholog | 732 |
| pMON98435 | Dv211_R12E2_3; putative rpn-8, translation initiation factor, 26S proteasome regulatory complex, subunit RPN8: R12E2_3 ortholog | 733 |
| pMON98447 | Dv212_C17H12_14; putative vha-8, hydrogen-exporting ATPase: C17H12_14 ortholog | 734 |

TABLE 6-continued

Additional dsRNA Constructs Demonstrating Significant Stunting and/or Mortality Effect in Insect Feeding Bioassays with Southern Corn Rootworm or Western Corn Rootworm

| Vector | Sequence Expressed as dsRNA | SEQ ID NO |
|---|---|---|
| pMON98448 | Dv213_B0464_1; putative drs-1, tRNA ligase: B0464_1 ortholog | 735 |
| pMON101059 | Dv214_F53G12_10; putative rpl-7, structural constituent of ribosome: F53G12_10 ortholog | 736 |
| pMON98442 | Dv216_C52E4_4; putative rpt-1, ATPase subunit of the 19S regulatory complex of the proteasome: C52E4_4 ortholog | 737 |
| pMON98441 | Dv218_K01G5_4; putative ran-1, small monomeric GTPase: K01G5_4 ortholog | 738 |
| pMON98440 | Dv219_C15H11_7; putative pas-1, endopeptidase: C15H11_7 ortholog | 739 |
| pMON101081 | Dv223_R10E11.1; putative cbp-1, homolog of transcriptional cofactors CBP and p300: R10E11.1 ortholog | 740 |
| pMON101050 | Dv224_F11C3_3; putative unc-54, ATP binding; motor activity: F11C3_3 ortholog | 741 |
| pMON101051 | Dv225_C37H5_8; putative hsp-6, heat shock protein 6: C37H5_8 ortholog | 742 |
| pMON38888 | Dv226_C47E12.5; putative uba-1, ubiquitin activating enzyme: C47E12.5 ortholog | 743 |
| pMON38887 | Dv227_F54A3.3; putative Chaperonin complex component, TCP-1 gamma subunit: F54A3.3 ortholog | 744 |
| pMON101110 | Dv229_D1081.8; putative Myb-like DNA binding: D1081.8 ortholog | 745 |
| pMON101052 | Dv230_F55A11_2; putative syn-3, protein transporter; syntaxin: F55A11_2 ortholog | 746 |
| pMON101107 | Dv231_C30C11.1; putative mitochondrial ribosomal protein L32: C30C11.1 ortholog | 747 |
| pMON101055 | Dv232_B0250_1; putative rpl-2, structural constituent of ribosome: B0250_1 ortholog | 748 |
| pMON98446 | Dv233_F54C9_5; putative rpl-5, 5S rRNA binding, structural constituent of ribosome: F54C9_5 ortholog | 749 |
| pMON101138 | Dv235_C04F12.4; putative rpl-14, large ribosomal subunit L14 protein: C04F12.4 ortholog | 750 |
| pMON98449 | Dv236_C01G8_5; putative erm-1, Ezrin/Radixin/Moesin (ERM) family of cytoskeletal linkers: C01G8_5 ortholog | 751 |
| pMON98439 | Dv237_F57B9_10; putative rpn-6, proteasome Regulatory Particle, Non-ATPase-like: F57B9_10 ortholog | 752 |
| pMON98436 | Dv240_F53A3_3; putative rps-22, structural constituent of ribosome: F53A3_3 ortholog | 753 |
| pMON101078 | Dv241_F32H2.5; putative alcohol dehydrogenase, zinc-dependent: F32H2.5 ortholog | 754 |
| pMON101058 | Dv242_B0336_2; putative arf-1, small monomeric GTPase: B0336_2 ortholog | 755 |
| pMON101057 | Dv244_C14B9_7; putative rpl-21, structural constituent of ribosome: C14B9_7 ortholog | 756 |
| pMON98444 | Dv245_C26F1_4; putative rps-30, Ribosomal Protein, Small subunit: C26F1_4 ortholog | 757 |
| pMON98434 | Dv247_C13B9_3; putative delta subunit of the coatomer (COPI) complex: C13B9_3 ortholog | 758 |
| pMON101053 | Dv248_F38E11_5; putative vesicle coat complex COPI, beta' subunit: F38E11_5 ortholog | 759 |
| pMON98445 | Dv249_F37C12_9; putative rps-14, structural constituent of ribosome: F37C12_9 ortholog | 760 |
| pMON101056 | Dv250_CD4_6; putative pas-6, endopeptidase: CD4_6 ortholog | 761 |
| pMON101104 | Dv251_D1007.12; putative rpl-24.1, structural constituent of ribosome: D1007.12 ortholog | 762 |
| pMON101088 | Dv252_C49H3.11; putative rps-2, structural constituent of ribosome: C49H3.11 ortholog | 763 |
| pMON101079 | Dv253_C26D10.2; putative hel-1, ATP-dependent RNA helicase: C26D10.2 ortholog | 764 |
| pMON101085 | Dv254_B0336.10; putative rpl-23, structural constituent of ribosome: B0336.10 ortholog | 765 |
| pMON38879 | Dv255_C36A4.2; putative member of Cytochrome P450 family: C36A4.2 ortholog | 766 |
| pMON101087 | Dv256_K05C4.1; putative pbs-5, proteasome beta subunit: K05C4.1 ortholog | 767 |
| pMON101082 | Dv257_F29G9.5; putative rpt-2, 26S proteasome regulatory complex: F29G9.5 ortholog | 768 |
| pMON101084 | Dv258_F40F8.10; putative rps-9, structural constituent of ribosome: F40F8.10 ortholog | 769 |
| pMON101083 | Dv259_K07D4.3; putative rpn-11, 26S proteasome regulatory complex, subunit RPN11: K07D4.3 ortholog | 770 |
| pMON101080 | Dv260_F49C12.8; putative rpn-7, proteasome Regulatory Particle, Non-ATPase-like: F49C12.8 ortholog | 771 |
| pMON101115 | Dv261_D1054.2; putative pas-2, endopeptidase: D1054.2 ortholog | 772 |
| pMON101141 | Dv263_F55A3.3; putative metalloexopeptidase: F55A3.3 ortholog | 773 |

TABLE 6-continued

Additional dsRNA Constructs Demonstrating Significant Stunting and/or Mortality Effect in Insect Feeding Bioassays with Southern Corn Rootworm or Western Corn Rootworm

| Vector | Sequence Expressed as dsRNA | SEQ ID NO |
|---|---|---|
| pMON101126 | Dv264_F56F3.5; putative rps-1, structural constituent of ribosome: F56F3.5 ortholog | 774 |
| pMON101133 | Dv266_C09D4.5; putative rpl-19, structural constituent of ribosome: C09D4.5 ortholog | 775 |
| pMON38881 | Dv268_R06A4.9; putative Polyadenylation factor I complex, subunit PFS2: R06A4.9 ortholog | 776 |
| pMON101135 | Dv271_F37C12.4; putative rpl-36, structural constituent of ribosome: F37C12.4 ortholog | 777 |
| pMON101132 | Dv273_F54E7.2; putative rps-12, structural constituent of ribosome: F54E7.2 ortholog | 778 |
| pMON101139 | Dv274_C23G10.4; putative rpn-2, proteasome Regulatory Particle, Non-ATPase-like: C23G10.4 ortholog | 779 |
| pMON101130 | Dv275_C03D6.8; putative rpl-24.2, structural constituent of ribosome: C03D6.8 ortholog | 780 |
| pMON101119 | Dv276_C26E6.4; putative DNA-directed RNA polymerase: C26E6.4 ortholog | 781 |
| pMON101134 | Dv277_R13A5.8; putative rpl-9, structural constituent of ribosome: R13A5.8 ortholog | 782 |
| pMON101127 | Dv279_F42C5.8; putative rps-8, structural constituent of ribosome: F42C5.8 ortholog | 783 |
| pMON101122 | Dv280_F13B10.2; putative rpl-3, large ribosomal subunit L3: F13B10.2 ortholog | 784 |
| pMON101116 | Dv281_T05C12.7; putative cct-1, Chaperonin complex component, TCP-1 alpha subunit: T05C12.7 ortholog | 785 |
| pMON101125 | Dv282_F07D10.1; putative rpl-11.2, structural constituent of ribosome: F07D10.1 ortholog | 786 |
| pMON38883 | Dv283_T05H4.6; putative Peptide chain release factor 1 (eRF1): Dv283_T05H4.6 ortholog | 787 |
| pMON101124 | Dv284_C47E8.5; putative daf-21, Heat shock 90 protein, chaperone activity: C47E8.5 ortholog | 788 |
| pMON101120 | Dv285_M03F4.2; putative act-4, actin: M03F4.2 ortholog | 789 |
| pMON101137 | Dv286_F25H5.4; putative eft-2, translation elongation factor: F25H5.4 ortholog | 790 |
| pMON101140 | Dv287_F26D10.3; putative hsp-1, Heat shock protein: F26D10.3 ortholog | 791 |
| pMON101117 | Dv288_F28D1.7; putative rps-23, structural constituent of ribosome: F28D1.7 ortholog | 792 |
| pMON38886 | Dv290_CG11979; putative H-exporting ATPase: CG11979 ortholog | 793 |
| pMON38885 | Dv291_CG13628; putative H-exporting ATPase: CG13628 ortholog | 794 |
| pMON101103 | Dv293_CG31237; putative DNA-directed RNA polymerase II: CG31237 ortholog | 795 |
| pMON101096 | Dv294_CG8669; putative cryptocephal; transcription factor, involved in molting cycle, pupariation and metamorphosis: CG8669 ortholog | 796 |
| pMON101095 | Dv295_CG8048; putative Vacuolar H+ ATPase 44 kD C subunit: CG8048 ortholog | 797 |
| pMON101100 | Dv298_CG9032; putative H-exporting ATPase: CG9032 ortholog | 798 |
| pMON101111 | Dv299_CG17369; putative H-exporting ATPase: CG17369 ortholog | 799 |
| pMON101129 | Dv303_CG4152; putative ATP-dependent RNA helicase: CG4152 ortholog | 800 |
| pMON101136 | Dv305_CG4916; putative ATP-dependent RNA helicase: CG4919 ortholog | 801 |
| pMON101131 | Dv315_CG9160; putative NADH dehydrogenase: CG9160 ortholog | 802 |
| pMON101123 | Dv316_CG8764; putative ubiquinol-cytochrome-c reductase: CG8764 ortholog | 803 |
| pMON98364 | C4_Dv49_CG8055 concatemer; putative binding, carrier activity: CG8055 ortholog | 804 |
| pMON98365 | C5_Dv49_CG8055 concatemer; putative binding, carrier activity: CG8055 ortholog. | 805 |
| pMON98368 | C6 concatemer of highly effective WCR targets, ~50% GC criterion, consisting of segments in order 5'-3' from Dv26, Dv49, Dv23, Dv20, Dv13, Dv22, Dv18 | 806 |
| pMON98369 | C7 concatemer of insect-specific targets, ~50% GC criterion, consisting of segments in order 5'-3' from Dv6, Dv1, Dv88, Dv93, Dv4, Dv113, Dv127, Dv99 | 807 |
| pMON98372 | C8 concatemer; putative sodium/potassium-exchanging ATPase: CG9261 ortholog | 808 |
| pMON98373 | C9 concatemer; putative sodium/potassium-exchanging ATPase: CG9261 ortholog | 809 |
| pMON98366 | C10 concatemer of genes with putative same/different mode of action, ~50% GC criterion | 810 |
| pMON98367 | C12 concatemer of highly effective WCR targets, ~50% GC criterion, consisting of segments in order 5'-3' from Dv23-Dv13-Dv26-Dv18-Dv49-Dv22-Dv20. | 811 |

TABLE 6-continued

Additional dsRNA Constructs Demonstrating Significant Stunting and/or Mortality Effect in Insect Feeding Bioassays with Southern Corn Rootworm or Western Corn Rootworm

| Vector | Sequence Expressed as dsRNA | SEQ ID NO |
|---|---|---|
| pMON98371 | C14 concatemer of gene targets active in several different organisms, ~50% GC criterion | 812 |
| pMON98503 | Comprising DV49 putative ESCRT-III (endosomal sorting complex required for transport III) complex subunit from *Diabrotica virgifera* | 820 |
| pMON98504 | Comprising putative Vha68-2: CG3762 ortholog; 250 bp concatamer C1; | 821 |
| pMON102862 | Dv319_CG14750; putative ESCRTII, Vps25: CG14750 ortholog | 835 |
| pMON102863 | Dv320_CG9712; putative ESCRTI, Vps23: CG9712 ortholog | 836 |
| pMON102861 | Dv321_CG12770; putative ESCRTI, Vps28: CG12770 ortholog | 837 |
| pMON102865 | Dv322_CG14542; putative ESCRT III, Vps2: CG14542 ortholog | 838 |
| pMON102866 | Dv323_CG4071; putative ESCRT III, Vsp20: CG4071 ortholog | 839 |
| pMON102871 | Dv326_CG3564; putative protein carrier, component of the COPI vesicle coat: CG3564 ortholog | 840 |
| pMON102873 | Dv327_CG6223; putative coatomer, component of the COPI vesicle coat: CG6223 ortholog | 841 |
| pMON102877 | Dv328_CG6948; putative Clathrin light chain, coat of coated pit: CG6948 ortholog | 842 |
| pMON102872 | Dv330_CG9543; putative COPI vesicle coat: CG9543 ortholog | 843 |
| pMON102879 | Dv331_CG5183; putative KDEL sequence binding: CG5183 ortholog | 844 |
| pMON102867 | Dv335_F11C1.6; putative nhr-25, DNA binding: F11C1.6 ortholog | 845 |
| pMON102870 | Dv337_CG18734; putative furin 2, serine-type endopeptidase: CG18734 ortholog | 846 |
| pMON102875 | Dv329_CG7961; putative coatomer, component of the COPI vesicle coat: CG7961 ortholog | 874 |

Efficacy tests were conducted as follows, utilizing progeny of corn plants transformed with selected insect control constructs:

1. Seven days post planting: incubate 10,000 WCR eggs per event (10 plants per event) at 25° C., 60% RH in complete darkness for seven days.

2. Fourteen days post infestation: plants are transplanted from 4" peat pots to 8" pots; v4 root tip samples may be taken for gene expression studies.

3. Fourteen days post planting: wash the WCR eggs out of the soil. Place the eggs and soil into a 60-mesh screen and place a 30-mesh screen on top of the 60-mesh screen to protect the eggs from the water stream. Rinse thoroughly with warm water using a spray nozzle until the soil is removed.

4. Suspend the eggs in a 2% (w/v) Difco agar solution, 25 mL of solution per 1 mL of eggs. The eggs are infested into the soil in about 3 or 4 aliquots using, for example, an Eppendorf repeater pipette, about 1000 eggs per plant. Holes are made into the soil using a spatula prior to infestation and covered after infestation.

5. Twenty-eight days post planting v8 root tip samples may be taken for gene expression studies.

6. Thirty-five days post planting; the assay is evaluated. Plants are cut down using pruning sheers, leaving about 6" of stalk. Plant stakes containing the event information are hole-punched and zip tied to the stalk. As much soil as possible is removed from the root system. The remainder of the soil is washed off using a spray hose.

7. The roots are examined and given a root damage rating by using the Olsen (0-3) NIS scale for WCR larvae damage.

Figure 1:
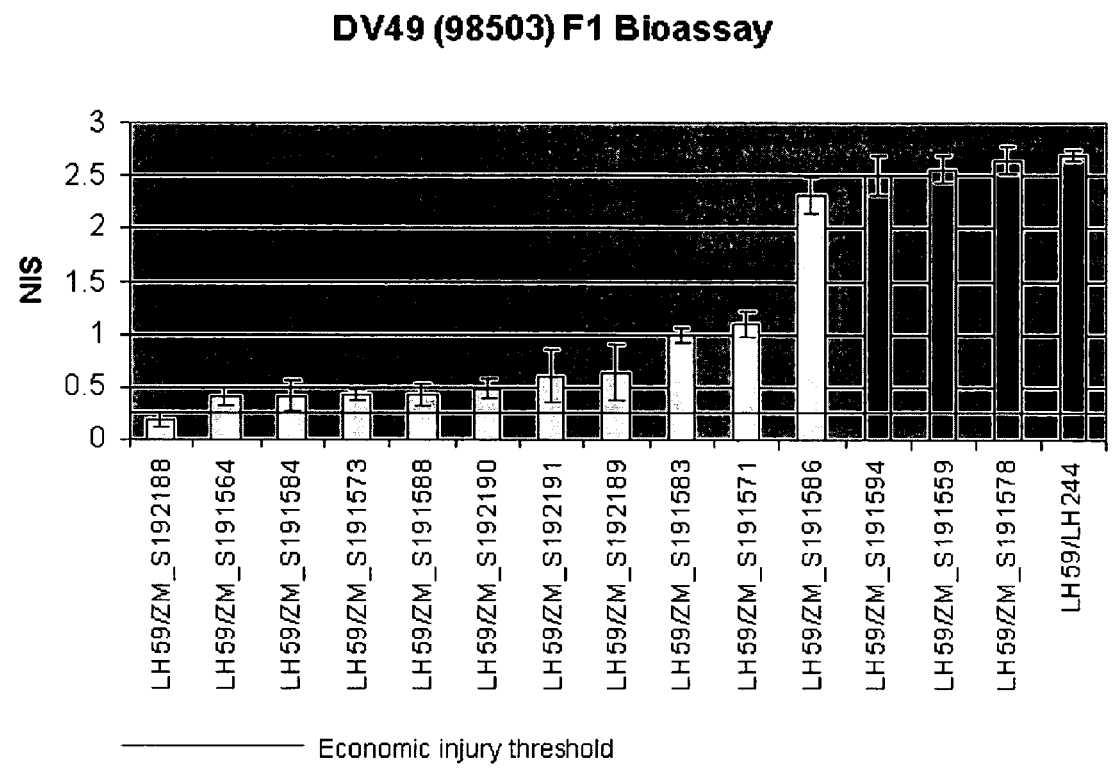

FIG. 1 and FIG. 2 illustrate insect control results obtained following challenge of F1 corn plants (derived from plants transformed with either pMON98503 or pMON98504) with WCR. In growth chamber efficacy tests performed essentially as described above, NIS scores at or below the economic injury threshold were seen in progeny of events derived by transformation with pMON98503 or pMON98504.

Full length EST DNA sequences were assembled for selected genes described in Examples 3 and 7 displaying significant activity versus Western Corn Rootworm. These EST sequences are listed in Table 7:

TABLE 7

Assembled EST Sequences for WCR Targets

| Assembled Sequence | SEQ ID NO |
|---|---|
| Dv9 full length (aka Apple); putative ortholog of CG2331 | 813 |
| Dv10 full length (Rp19); putative ortholog of CG6141 | 814 |
| Dv11 full length (Rp119); putative ortholog of CG2746 | 815 |
| Dv13 full length (Rps4); putative ortholog of CG11276 | 816 |
| Dv35 full length v-ATPase A; ortholog of CG3762 | 817 |
| Dv49 full length ortholog of CG8055 | 818 |
| Dv248 full length putative ortholog of CG6699 | 819 |

Example 8

Creation and Efficacy Results for Dv49 and Dv248 Sequences

Figure 3:
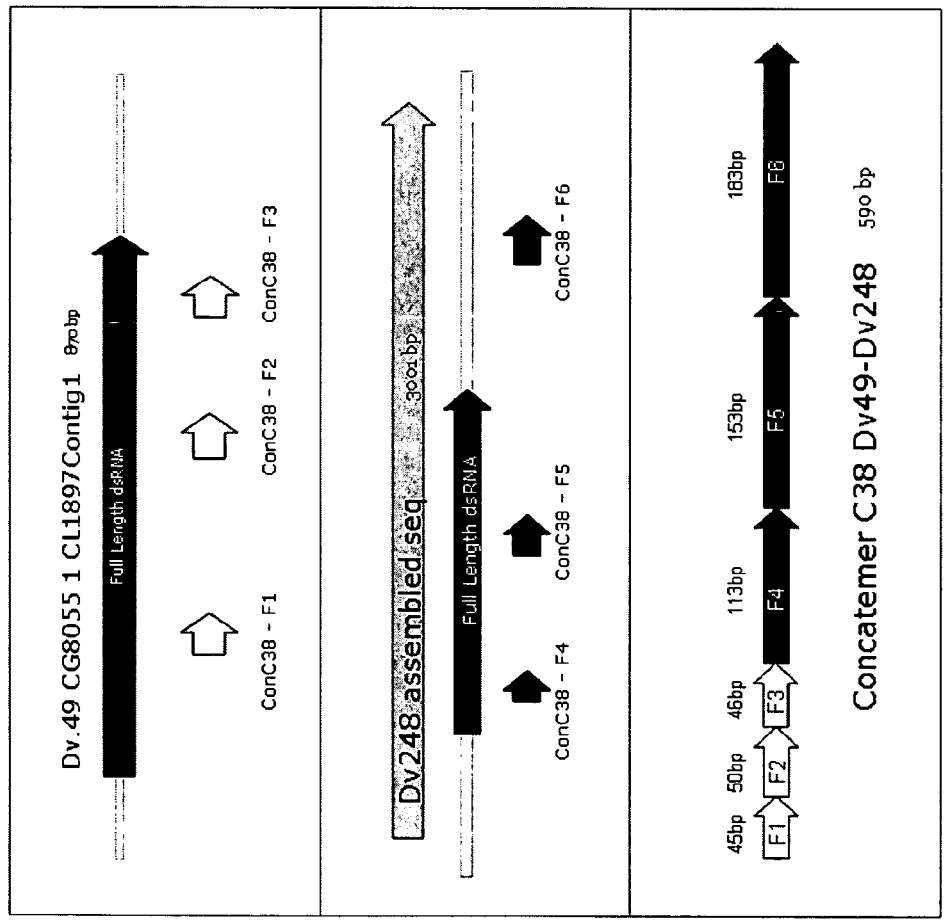
FIG. 3: Selection of Dv49 and Dv248 fragments and schematic design of Dv49-Dv248 concatemer C38.
Figure 4:
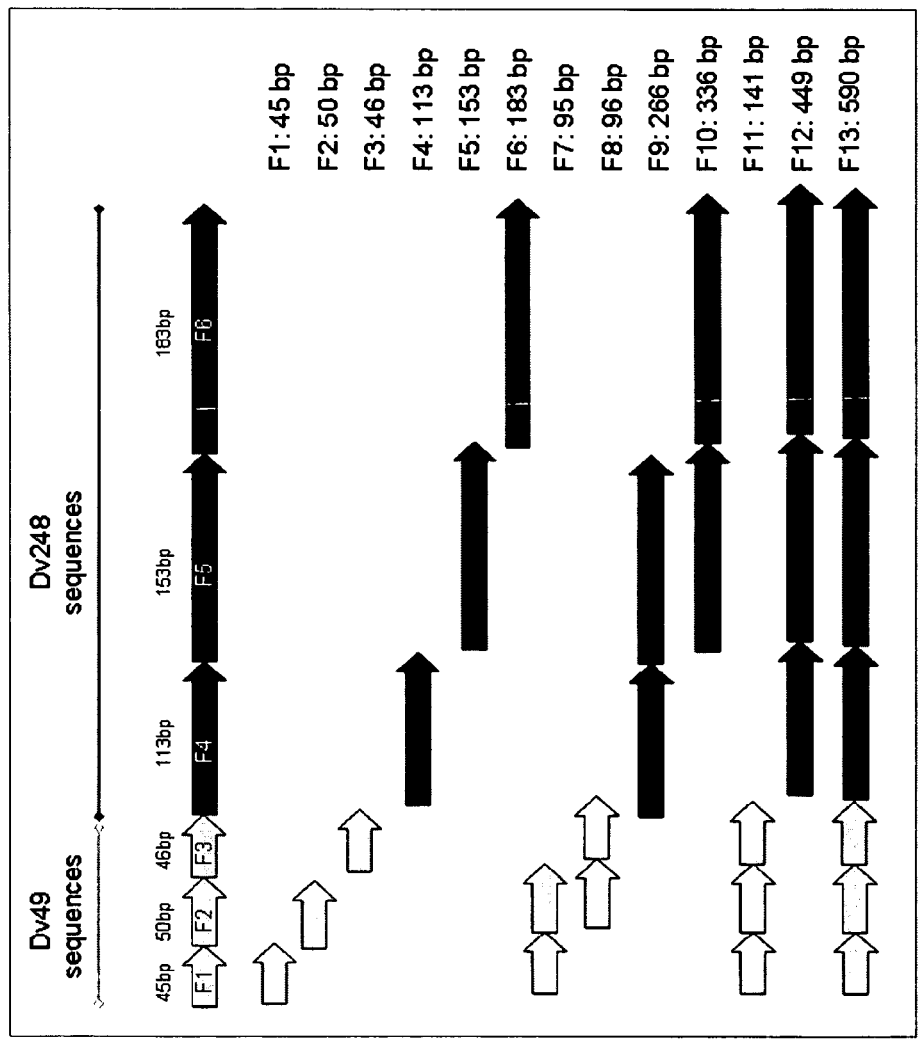
FIG. 4: dsRNAs F1-F13 synthesized based on concatemer C38.

Portions of the assembled EST and adjacent sequences of Dv49 (SEQ ID NO:818) and Dv248 (SEQ ID NO:819) were selected for further bioactivity assays based on criteria including predicted function, phenotype of knockout mutants of corresponding coding regions in other organisms, segment length, GC content, similarity to known sequences, and predicted secondary structure (e.g. Elbashir, et al., 2001b). The respective Dv49 and Dv248 sequences were synthesized in vitro based on their predicted activity against WCR individually, as well as grouped as shown in FIGS. 3-4, and Table 8, and applied to WCR larvae.

TABLE 8

Dv49 and Dv248 Fragments Assessed for Efficacy Against WCR

| Fragment | SEQ ID NO |
|---|---|
| F1 | 822 |
| F2 | 823 |
| F3 | 824 |
| F4 | 825 |
| F5 | 826 |
| F6 | 827 |
| F7 | 828 |
| F8 | 829 |
| F9 | 830 |
| F10 | 831 |
| F11 | 832 |
| F12 | 833 |
| F13 | 834 |

Fragments F1-F3 correspond to portions of the full length Dv49 transcript. Fragments F4-F6 correspond to portions of the Dv248 transcript or flanking region. Fragments F7-F13 are concatemers of two or more of fragments F1-F6, as shown in FIG. 4. Fragment F13 (SEQ ID NO:834) represents the C38 (Dv49-Dv248) concatemer.

Figure 5:
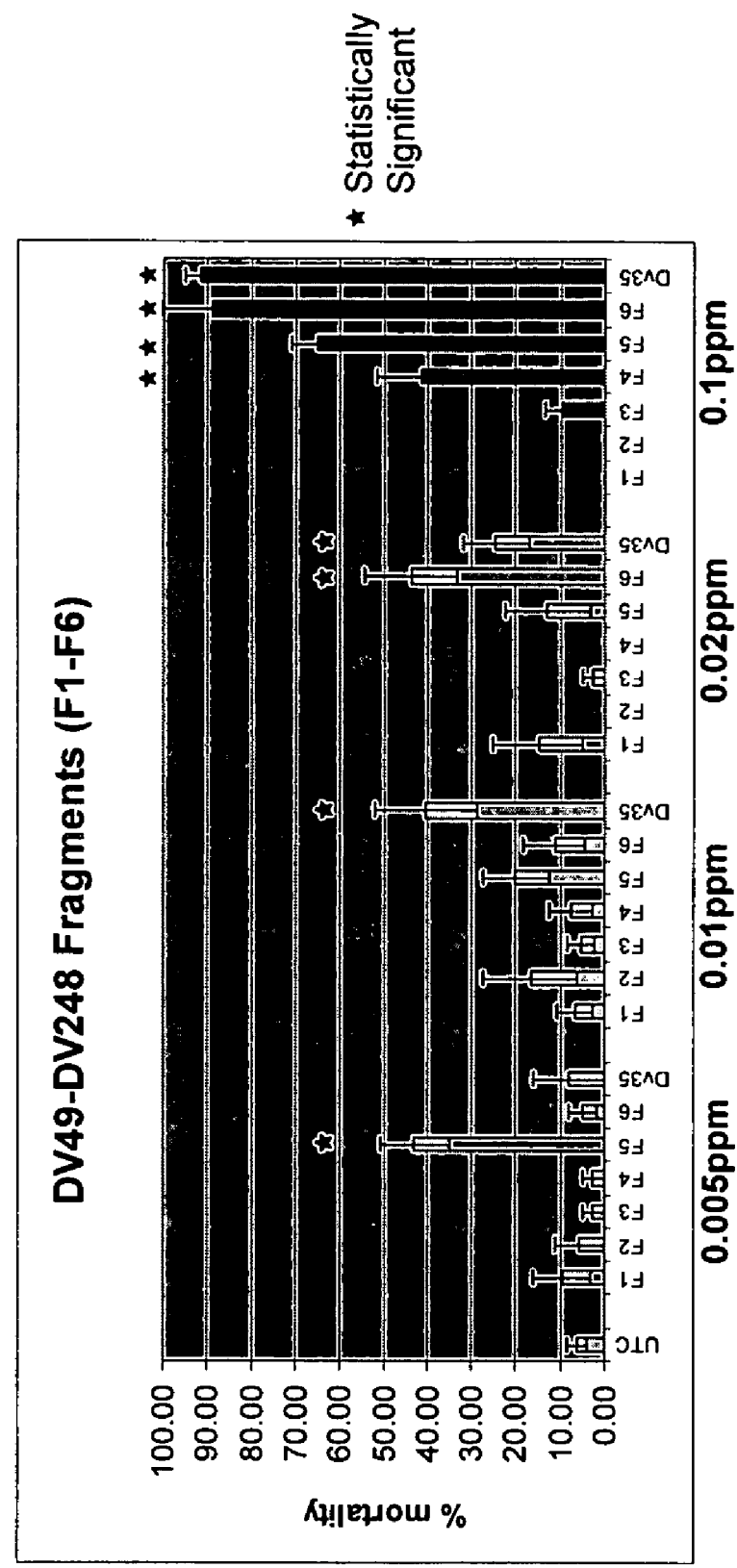
FIG. 5: DV49-DV248 concatemer 38 dose response (Fragments F1-F6).
Figure 6:
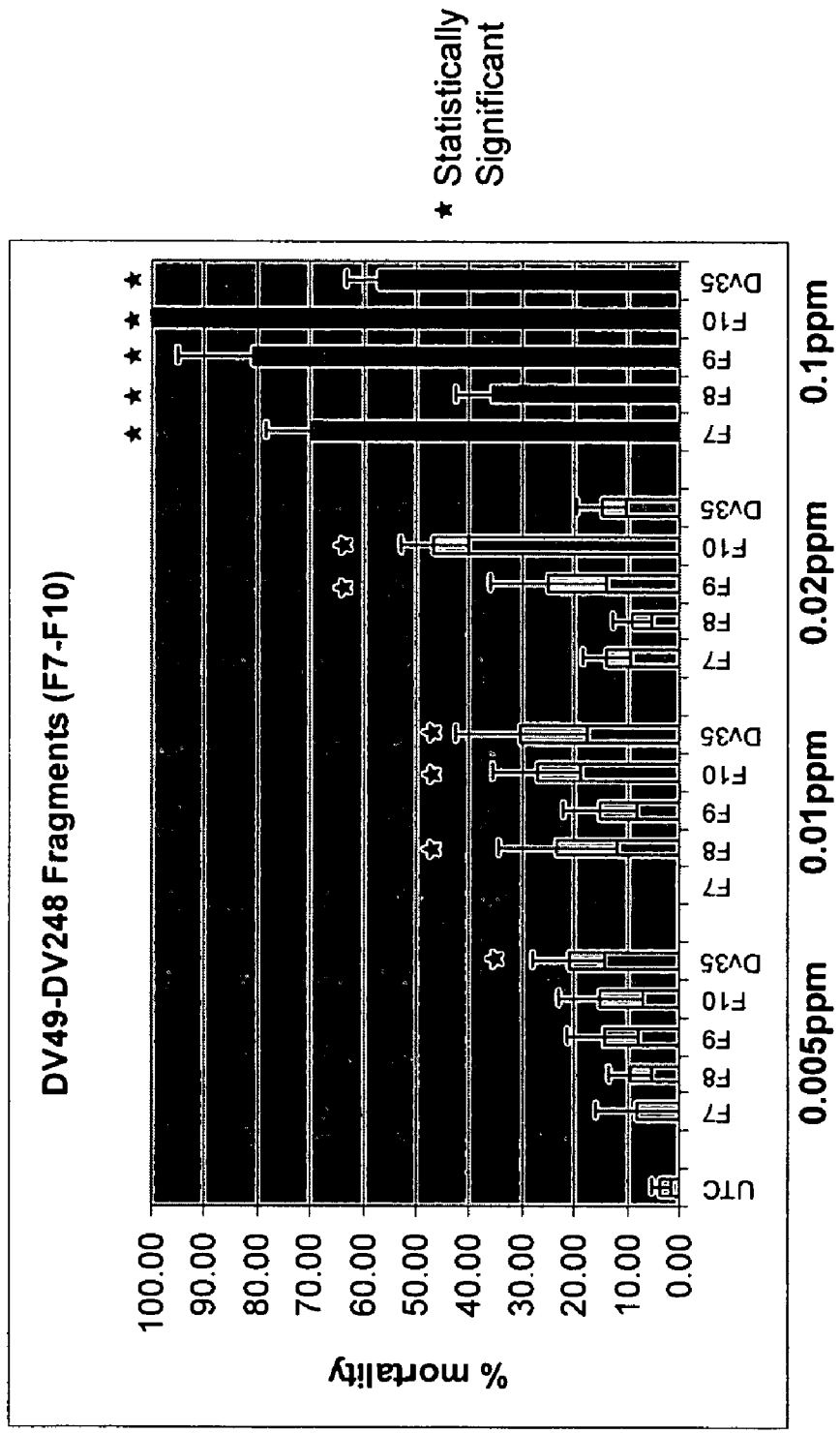
FIG. 6: DV49-DV248 concatemer 38 dose response (Fragments F7-F10).

Dose Response data for F1-F13 is shown in FIGS. 5-7. As shown in FIG. 5, activity (larval % mortality) of fragments F4-F6, comprising Dv248-derived sequences (FIG. 4), was significantly better than the control when fed to WCR larvae at 0.1 ppm. Fragment F6 displayed significant activity when fed at 0.02 ppm as well. Activity of fragment F5 at the lowest dose is likely an artifact, since surviving larvae displayed no stunting.

As shown in FIG. 6, each of fragments F7-F10 displays statistically significant activity when fed to WCR larvae at 0.1 ppm. Fragments F9 and F10 also displayed statistically significant activity when fed to WCR larvae at 0.02 ppm, and fragment F10 displayed statistically significant activity when fed to WCR larvae at 0.01 ppm as well. Activity of F8 at 0.01 ppm may be an artifact.

As shown in FIG. 7, fragments F11-F13 display statistically significant activity when fed to WCR larvae at 0.02 ppm or higher. Additionally, the largest fragments (F12 and F13) show activity at 0.005 ppm and higher.

Example 9

Additional Active Concatemer Sequences Derived From Concatemer C6

As shown in Table 9, portions of active concatemer C6 (SEQ ID NO:806), derived from pMON98368, were identified in diet overlay bioassays (performed as described e.g. in Example 2) as inhibiting the growth and/or survival of corn rootworm (WCR). The C6 full length concatemer contains 7 target subfragments of 70 bp each, as noted in Table 6 and Table 9.

TABLE 9

Efficacy of full length C6 concatemer and selected sub-portions in rootworm diet bioassay (SEQ ID NOs: 806, 847-873).

| Concatemer | Segments | % Mortality at 1 ppm | SEQ ID NO |
|---|---|---|---|
| C6_full length | Dv26-Dv49-Dv23-Dv20-Dv13-Dv22-Dv18 | 100 | 806 |
| C6.1 | Dv26-Dv49 | 35.3 | 847 |
| C6.2 | Dv26-Dv49-Dv23 | 57.1 | 848 |
| C6.3 | Dv26-Dv49-Dv23-Dv20 | 84.7 | 849 |
| C6.4 | Dv26-Dv49-Dv23-Dv20-Dv13 | 51 | 850 |
| C6.5 | Dv26-Dv49-Dv23-Dv20-Dv13-Dv22 | 41.3 | 851 |
| C6.6 | Dv49-Dv23 | 94.6 | 852 |
| C6.7 | Dv49-Dv23-Dv20 | 75.6 | 853 |
| C6.8 | Dv49-Dv23-Dv20-Dv13 | 50 | 854 |
| C6.9 | Dv49-Dv23-Dv20-Dv13-Dv22 | 56.4 | 855 |
| C6.10 | Dv49-Dv23-Dv20-Dv13-Dv22-Dv18 | 52.5 | 856 |
| C6.11 | Dv23-Dv20 | 74.6 | 857 |
| C6.12 | Dv23-Dv20-Dv13 | 63.4 | 858 |
| C6.13 | Dv23-Dv20-Dv13-Dv22 | 58.5 | 859 |
| C6.14 | Dv23-Dv20-Dv13-Dv22-Dv18 | 60.8 | 860 |
| C6.15 | Dv20-Dv13 | 57.5 | 861 |
| C6.16 | Dv20-Dv13-Dv22 | 20 | 862 |
| C6.17 | Dv20-Dv13-Dv22-Dv18 | 44.8 | 863 |
| C6.18 | Dv13-Dv22 | 71.1 | 864 |
| C6.19 | Dv13-Dv22-Dv18 | 52.5 | 865 |
| C6.20 | Dv22-Dv18 | 44.6 | 866 |
| C6.28 | Dv26 | 58.9 | 867 |
| C6.29 | Dv49 | 72.3 | 868 |
| C6.30 | Dv23 | 71.9 | 869 |
| C6.31 | Dv20 | 62.6 | 870 |
| C6.32 | Dv13 | 54.2 | 871 |
| C6.33 | Dv22 | 56.7 | 872 |
| C6.34 | Dv18 | 44.6 | 873 |

Full length concatemer C7 contains 8 target sub-fragments of 70 bp each, as noted in Table 6. Similarly, full length concatemer C12 contains 7 target sub-fragments from Dv23-Dv13-Dv26-Dv18-Dv49-Dv22-Dv20, ranging in length between 53-80 bp, as noted in Table 6 and Table 10.

TABLE 10

Composition of full length C12 concatemer and selected sub-portions (SEQ ID NOs: 811, 887-892).

| Concatemer | Segments | Included sequence (SEQ ID NO) in 5'-3' direction |
|---|---|---|
| C12_full length | Dv23-Dv13-Dv26-Dv18-Dv49-Dv22-Dv20 | 811 |
| C12.1 | Dv23-Dv13 | 887 |
| C12.2 | Dv23-Dv13-Dv26 | 888 |
| C12.3 | Dv23-Dv13-Dv26-Dv18 | 889 |
| C12.4 | Dv23-Dv13-Dv26-Dv18-Dv49 | 890 |
| C12.5 | Dv23-Dv13-Dv26-Dv18-Dv49-Dv22 | 891 |
| C12.6 | Dv13-Dv26 | 892 |
| C12.7 | Dv13-Dv26-Dv18 | 893 |
| C12.8 | Dv13-Dv26-Dv18-Dv49 | 894 |
| C12.9 | Dv13-Dv26-Dv18-Dv49-Dv22 | 895 |
| C12.10 | Dv13-Dv26-Dv18-Dv49-Dv22-Dv20 | 896 |
| C12.11 | Dv26-Dv18 | 897 |
| C12.12 | Dv26-Dv18-Dv49 | 898 |
| C12.13 | Dv26-Dv18-Dv49-Dv22 | 899 |
| C12.14 | Dv26-Dv18-Dv49-Dv22-Dv20 | 900 |
| C12.15 | Dv18-Dv49 | 901 |
| C12.16 | Dv18-Dv49-Dv22 | 902 |
| C12.17 | Dv18-Dv49-Dv22-Dv20 | 903 |
| C12.18 | Dv49-Dv22 | 904 |
| C12.19 | Dv49-Dv22-Dv20 | 905 |
| C12.20 | Dv22-Dv20 | 906 |

Table 11 lists additional sequences for use in targeting other coleopteran pests, including *Diabrotica* sp. and other *Coccinellidae* and *Chrysomelidae*.

TABLE 11

Additional Coleopteran Target Sequences

| Sequence and source | SEQ ID NO |
|---|---|
| Dbar248_CG6699 (*D. barberi*) | 875 |
| Dbal248_CG6699 (*D. balteata*) | 876 |
| Du248_CG6699 (*D. undecimpunctata howardi*) | 877 |
| Dz248_CG6699 (*D. virgifera zea*) | 878 |
| Dv248_CG6699 (*D. virgifera virgifera*) | 879 |
| Ev248_CG6699 (*Epilachna varivestis*) | 880 |
| Ld248_CG6699 (*Leptinotarsa decemlineata*) | 881 |
| Dbal49_CG8055_2 (*D. balteata*) | 882 |
| Db49_CG8055_2 (*D. barberi*) | 883 |
| Du49_CG8055_2 (*D. undecimpunctata howardi*) | 884 |
| Dz49_CG8055_2 (*D. virgifera zea*) | 885 |
| Dv49_CG8055_2 (*D. virgifera virgifera*) | 886 |

All of the compositions and methods disclosed and claimed herein can be made and executed without undue experimentation in light of the present disclosure. While the compositions and methods of this invention have been described in terms of the foregoing illustrative embodiments, it will be apparent to those of skill in the art that variations, changes, modifications, and alterations may be applied to the composition, methods, and in the steps or in the sequence of steps of the methods described herein, without departing from the true concept, spirit, and scope of the invention. More specifically, it will be apparent that certain agents that are both chemically and physiologically related may be substituted for the agents described herein while the same or similar results would be achieved. All such similar substitutes and modifications apparent to those skilled in the art are deemed to be within the spirit, scope, and concept of the invention as defined by the appended claims.

REFERENCES

The following references, to the extent they provide exemplary procedural or other details supplemental to those set forth herein, are specifically incorporated herein by reference:

U.S. Pat. No. 4,245,432; U.S. Pat. No. 4,272,417; U.S. Pat. No. 4,339,456; U.S. Pat. No. 4,372,080; U.S. Pat. No. 4,383,391; U.S. Pat. No. 4,465,017; U.S. Pat. No. 4,536,475; U.S. Pat. No. 4,634,587; U.S. Pat. No. 4,693,977; U.S. Pat. No. 4,735,015; U.S. Pat. No. 4,759,945; U.S. Pat. No. 4,876,197; U.S. Pat. No. 4,880,734; U.S. Pat. No. 4,886,937; U.S. Pat. No. 4,959,317; U.S. Pat. No. 5,080,925; U.S. Pat. No. 5,107,065; U.S. Pat. No. 5,107,787; U.S. Pat. No. 5,231,020; U.S. Pat. No. 5,283,184; U.S. Pat. No. 5,300,127; U.S. Pat. No. 5,302,523; U.S. Pat. No. 5,328,942; U.S. Pat. No. 5,384,253; U.S. Pat. No. 5,389,399; U.S. Pat. No. 5,464,765; U.S. Pat. No. 5,501,967; U.S. Pat. No. 5,527,695; U.S. Pat. No. 5,538,877; U.S. Pat. No. 5,538,880; U.S. Pat. No. 5,550,318; U.S. Pat. No. 5,554,445; U.S. Pat. No. 5,563,055; U.S. Pat. No. 5,580,544; U.S. Pat. No. 5,591,616; U.S. Pat. No. 5,593,874; U.S. Pat. No. 5,622,003; U.S. Pat. No. 5,633,435; U.S. Pat. No. 5,661,103; U.S. Pat. No. 5,698,425; U.S. Pat. No. 5,712,135; U.S. Pat. No. 5,759,829; U.S. Pat. No. 5,780,708; U.S. Pat. No. 5,789,214; U.S. Pat. No. 5,791,084; U.S. Pat. No. 5,804,693; U.S. Pat. No. 5,834,447; U.S. Pat. No. 5,837,848; U.S. Pat. No. 5,849,320; U.S. Pat. No. 5,876,739; U.S. Pat. No. 5,882,713; U.S. Pat. No. 5,891,246; U.S. Pat. No. 5,918,413; U.S. Pat. No. 5,939,356; U.S. Pat. No. 6,118,047; U.S. Pat. No. 6,326,193; U.S. Pat. No. 6,489,542; U.S. Pat. No. 6,506,559;

U.S. patent application Ser. No. 10/205,189; U.S. patent application Ser. No. 10/465,800; U.S. Patent Applic. Ser. 60/643,136

U.S. Patent Publn. 2002/0048814; U.S. Patent Publn. 2002/0048814; U.S. Patent Publn. 2003/0018993; U.S. Patent Publn. 2003/0061626; U.S. Patent Publn. 2003/0150017; U.S. Patent Publn. 2003/0175965; U.S. Patent Publn. 2004/0029283;

Altschul et al., *J. Mol. Biol.*, 215:403-410, 1990.

Ausubel et al., In: *Current Protocols in Molecular Biology*, John, Wiley & Sons, Inc, New York, 1998.

Babst et al., *Dev. Cell*, 3:271-282, 2002.

Beutler et al., *N. Engl. J. Med.*, 324(19):1370, 1991.

Bevan et al., *Nature*, 304:184-187, 1983.

Botstein et al., *Gene*, 8(1):17-24, 1979.

Brake et al., *Proc. Natl. Acad. Sci. USA*, 81(15):4642-4646, 1984.

Brutlag et al., *Computers and Chemistry*, 17:203-207, 1993.

Current Protocols in Molecular Biology, Ausubel et al. (Eds.), Greene Publishing and Wiley-Interscience, NY, 1989.

Dalmay et al., *Cell*, 101:543-553, 2000.

Dellaporta et al., In: *Chromosome Structure and Function: Impact of New Concepts*, 18th Stadler Genetics Symposium, 11:263-282, 1988.

Dow et al., *J. Exp. Biol.*, 200(Pt 2):237-245, 1997.

Dow, *J. Bioenerg. Biomembr.*, 31(1):75-83, 1999.

Elbashir et al., *Genes Dev.*, 5(2):188-200, 2001a.

Elbashir et al., *EMBO J.* 20: 6877-6888, 2001b.

Elbashir et al., *Methods*, 26:199-213, 2002.

European Appln. 0 120 516

European Appln. 0 122 791
European Appln. 0 127,328
Hamilton and Baulcombe, *Science*, 286(5441):950-952, 1999.
Hannon et al., *J. Mol. Neurosci.*, 18(1-2):15-27, 2002.
Haymes et al., In: *Nucleic acid hybridization, a practical approach*, IRL Press, Washington, D.C., 1985.
Herrera-Estrella et al., *Nature*, 303:209-213, 1983.
Ikatu et al., *Bio/Technol.*, 8:241-242, 1990.
Jefferson et al., *EMBO J.*, 6:3901-3907, 1987a.
Jefferson et al., *Plant Mol. Biol, Rep.*, 5:387-405, 1987b.
Kaeppler et al., *Plant Cell Rep.*, 8:415-418, 1990.
Katz et al., *J. Gen. Microbiol.*, 129:2703-2714, 1983.
Kennerdell and Carthew, *Cell*, 95:1017-1026, 1998.
Kennerdell and Carthew, *Nat. Biotechnol.*, 18:896-898, 2000.
Klee et al., *Bio-Technology*, 3(7):637-642, 1985.
Lovato et al., *Insect Mol. Biol.*, 10(4):333-340, 2001.
Lu et al., *Phytochemistry*, 53(8):941-946, 2000.
Mourrain et al., *Cell*, 101:533, 2000.
Myanohara et al., *Proc. Natl. Acad. Sci. USA*, 80(1):1-5, 1983.
Odell et al., *Nature*, 313:810-812, 1985.
Ogas et al., *Proc. Natl. Acad. Sci. USA*, 96(24):13839-13844, 1999.
Omirulleh et al., *Plant Mol. Biol.*, 21(3):415-428, 1993.
Orr-Weaver et al., *Proc. Natl. Acad. Sci. USA*, 80(14):4417-4421, 1983.
PCT Appln. WO 97/32016
PCT Appln. WO 99/53050
PCT Appln. WO 99/49029
PCT Appln. WO 94/01550
PCT Appln. WO 98/05770
Peragine et al, *Genes Dev.*, 18(19):2368-2379, 2004.
Pleau et al., *Entomol. Exp. Appl.* 105:1-11, 2002.
Pontius et al., In: *UniGene: A unified view of the transcriptome*. NCBI handbook. National Center for Biotechnology Information, Bethesda, Md., 2003.
Potrykus et al., *Mol. Gen. Genet.*, 199(2):169-177, 1985.
Rajagopal et. al., *J. Biol. Chem.*, 277:46849-46851, 2002.
Rine et al., *Proc. Natl. Acad. Sci. USA*, 80(22):6750-6754. 1983.
Sambrook et al., In: *Molecular cloning: a laboratory manual*, $2^{nd}$ Ed., Cold Spring Harbor Laboratory Press, Cold Spring Harbor, N.Y., 1989.
Schnepf et al., *Microbiol. Mol. Biol. Rev.*, 62(3):775-806, 1998.
Smith et al., *Cell Dev. Biol.*, 33:75-79; 1997.
Stinchcomb et al., *J. Mol. Biol.*, 158(2):157-190, 1982.
Sutcliffe et al., *Proc. Natl. Acad. Sci. USA*, 75:3737-3741, 1978.
Tabara et al., *Science*, 282(5388):430-431, 1998.
Tabashnik, *Appl. Environ. Microbiol.*, 58(10):3343-3346, 1992.
Van Heeke and Schuster, *J. Biol. Chem.*, 264(33):19475-19477, 1989.
Vazquez et al, *Mol. Cell*, 16(1):69-79, 2004.
Yadav et al., *Molec. Biochem. Parasitol.*, doi:10.1016/j.molbiopara.2006.03.013; in press, 2006.
Zukowsky et al., *Proc. Natl. Acad. Sci. USA*, 80:1101-1105, 1983.

SEQUENCE LISTING (906 sequences)

SEQ ID NO: 1 - DNA, 888 bp, Diabrotica virgifera
  modified_base (775): n = a, c, g or t/u
cccacgcgtccggcggctgataaaagcctaatgattggagctgatgtagcagttgcttacattgatggattcagagggtttgctacggactacaatataacagctttaacaccatgtgtaaaagtattaggccaatataaaggagtatgcaaggatgaaatggtaggaggacaggatagcaaccaaatgaatacggcagcgagggaaaatggtattagcataataacttacagaagatccttaatttcacctgatcctggagataaagagtttccagcagagggttccatatacgccgtatggggggtaggaaaactagacgaaatgaaagaacctgcttttcatgatctctactcaaagactgatataaaaatggagatgacaccgaaagaacctcagaataactgtgtctcttttacgagatcgaaacctgaacccaaagaaccttggaagaaaggtcaaatattcgataaaactataaggatatttaagtcttatattggtccatcaggggccaaaaggggataccaagccattaccggccactcatccacagctttagcatggtacataaacggtttcctcagccctgagatatggctacgacgaggtctttcatatgcatttaaagtatatggaggaaacaatccacacagtgctgaatattatcatccattgataataacagatgaaccccacggaggttttgatagacttactgacgatgctcagtctaaaataagagtcttggctggtgttgaatattctagaaggngaagacctagaccaactacatctggtgtcctttgtctatcagaacacaaagaaggaaaagacagaagactcgatgatgacttcgaaacgttcaaaaatttcacaaatcttgat

SEQ ID NO: 2 - DNA, 381 bp, Diabrotica virgifera
aactactcgtccgcatggggtacccgcgaggtcactgtcgcagccaaagcgcacgatgcaactcaagatgctacaccaagtgcatcacctgctcctgcgcccatttcaagccaaccattatcattttttggtaactccaaagataatgcgggatccctcgagttttctttcggacgactttttaaactagtgtgttgtacctacgatagtagtggcgaagaaacggaagtactcacgatcatacaaacctccattcagactatgcatgaattcttggcccagatggacaatcataaactatgagctacagattcgatcctgaaaccaagacaaatcgctagtcacactcagcattttgtgggtttacaagcttgaagattt

SEQ ID NO: 3 - DNA, 859 bp, Diabrotica virgifera
tggcgttttacaatgtcacaagtaactgcagattttgaacaatatttggagagatacttacagggctcctcgaaacttgcaattttgctagattatgatggtaccttgacacctatcgtggctcatccagatctagcagtaattcccccagaagcaaaaaatgttcttgaaatgttgtcgcaaatcccagaaatatttgttgctattatatcgggtagaggggtaacgaatgttaaaaaattggttggtattgactctattacatatgctggaaatcatggactggaagtcatctatccagacggttccaaatacgaccaccaacttccatctaatttcgaggaccaagtttaaagaactaatagccaagttacaagaaaaactgggaagagaaggtgcttggatagaaaacaaaggtgccagtctaacttttcattttagagaagcaccagcacacttaagggaagaaatggaaagagaagctaccaaaattatagaggcagcaaatttcaaatcttcaaaggcacatatggctgtagaggcaagaccaaaagttgattggaataagggaagcgtggcgctcttgcttttggagcagaaatacagaaagaactggaacaaagaggccaaggtgatatttgttggtgatgatacaactgatgaagatgctatgaaggctttgaaagggaatgcggctctgtttagaattgctaagccttgtgctgatacaaatgctgataaaattatttcgtctactgaagatacactaaaaatactgaaaatagctcaaaaacattttaagaaataatatatttcattgatgtatacatatatgtgattacaataatatatatgtaca

SEQ ID NO: 4 - DNA, 873 bp, Diabrotica virgifera
  modified_base (745): n = a, c, g or t/u
gagagagacaacagataacagttgtgtagtaaactgttcaagtgtaaacagtaaaccatcagtaaaccagtgacttatttaaacccctgacaaacggaacttattattgttgctaaaatggcattttcgatatttagacaatgcgtgaaaaacgggataacagtttctaacagaagtgcccttatggagggtgttttgaagaacacgctggcgaatgtgagttgcagatgtgttcccgtggcagctgtcaattttaacaattctatagtagctagaagttatagcaaacatgccaaacacacacacgcagaaaggaaatatcagtcagactcagaatcagatagtgatctggaatggattggacacagaggtgaatcagatttttggagaagaaaaatcagaaccttccatggaatcctcgacttaaataaggacggtgttatttcttttgacgacttcaaactgctcagtgatcggtttataaatctaggtcatttacgttcagaacaagtgaaaaaattccaggatgttcttaagaatctttgggagaagcagtttggagaaatatccccttacaacttagtctcagtggaaagatatttagaaaatatgcaccacgtgctcaacgataaaagactggtcaggaaggcacattcctttttgccttacttattcaaggcagttgataaagacagatccggagaaatctccgtggaagaatttaaattatttttcaatgtattgngcctcaaagaacaagacgccatcttagctttccgggcaatagactcaaacggaaatgaaaaaattaccccaaaaagagttcgtgaagcacgaaagagatttctttttgactgaagaccaagaaaggat

SEQ ID NO: 5 - DNA, 1384 bp, Diabrotica virgifera
ctattgtttcgtaaacttctttcagttctttagtaaatttgacagtatctacctcaatagataccttggcaccatgcgaggctttgcctgctggattcacagcaatacatttgtagtctccagagtcaagttcagaattggtttctttaatagttagttcaatgttttctccatcgaaggtgatctttaccctatcggatggttccaaaggctcattatttctaagccagtatacttcaggagtaggattgccaaccactttggctttgagggtgagaggagacttttgtggtacagtttgctcttcaaatcgtttgacgaacaatggtggttcctggttttctgggaattcttcaacagttaggtttgcacttgtttctattgtacccatagaattggtagctcgaactgtatatgtagcagtgtcatctgtagatgtcttgggaatagttaaagtgtatgtgtttccgtcttttttgaattttggtctggttaaaggtttaccatccttcaaccattcgatagtaggttccgggtttccaaatatagtagtggaaagtgtaactggttctcctttccttacggtaatagattctagaggtgataagacctcaggtgcttctttctctgaagtaattactttcagagtaaatgttactgaggcttctccttccctgttcctggcgactatcttaaacttgccttcctgagtcttcttgattttcttgatttttagagtggttttgtaagtatatagctcagaagttgacacaatactgacgttttcagttacacgtctaccattacagaaccattttatttcaggttgtggtactcctactaatgtactttcaactacgacgtctgtttcttcaggaacacactgtggtagaggcttcttagcgaatgttggtggtataccttctaatatatcagccaaggaagatgttcttgatagactcttccttgaaatggaagtcaattcggatccatgagatgacaacggaccttctactatgagttctgttgtactggaggcgaatcctgctgagtttttagcaacgcaagtgaaagttccagcatcttctgggaatacttcccttataataagggtagcgacgttatcttcatcgtagtagatttggaaatctttggaagttttgattatgtgagtttgtctgaaccacgtaatttggggacgagggaatccttctactttgcattcgaattggacagtgtaaccatctggggttataataggcttcaacttcttgatgaattttggcgcagaagctttatctttggattttggtttttcaaatacaggaagtttgtcaatcttctcgttcaatttctgttgtacatactgcgcatactgttcttc

SEQ ID NO: 6 - DNA, 735 bp, Diabrotica virgifera
ggaaaaggaagtgggggtgaataggccaaacaatgacaatggttttagctattaaagatgacgacaacaagtttgatatgttggtaaggaactgtatggctcacgatggaaaaagagctcccatacagttagtcgaccaaagaggttgtgtcacaagaccaaaattgatgtccagatttactaagattaaaaactttggcgcaagcgcttcagtgttatcatatgcccacttccaggcatttaaattccctgactccatggaagttcacttccagtgcaccatccaaatctgcagatatcaatgtccagatcagtgttcagattcttcaggacaacatctccacggcttgcttgatttggtgcatggtccacctgatactggttatggtgctcctccaccgctacctatcgaagcatatttacatcctgggcgaccaagggatgaaaggagatcaaagagagctctcgctgtcgacccggaaaaggaagtgggggtgaataggattattagggttgtatctacaggagatttgacatttacacttgacgaaaacagcaatagcacaactccacccactatggtctttcccgccaaggaggaaattaacaacggaggattaatatgtatgactactccaggttttgcagcaaccttagtagttttattagctatattaatagtatcttgtcttatgtcagctttcctttgtgtcaaactaagaccatttgctgaaa

SEQ ID NO: 7 - DNA, 888 bp, Diabrotica virgifera
gaacagcaaatttttgaagtgtcatactgtttttatttagcaaaatagttaattgggaacaaagattttattagaataatataccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgcatttaatacatcgttttacgtgaaaaataacgatcaaatgttagtcgtttatctagcag

SEQ ID NO: 8 - DNA, 29 bp, Diabrotica virgifera
ccgaaaatgccgagtcaagaattaacaac

SEQ ID NO: 9 - DNA, 26 bp, Diabrotica virgifera
gcatcctgatttatatcgggcaaaag

SEQ ID NO: 10 - DNA, 746 bp, Diabrotica virgifera
ccgaaaatgccgagtcaagaattaacaactaataaagtaatagtccaccctttggttcttctaagtgtggtggaccattttaatcgcatgggcaaaatcggcaatcaaaagcgtgttgttggtgttcttcttggctgttggcgtgctaaaggagtcttagatgtttctaacagttttgcagttccttttgacgaagatgacaaggataagtctgtgtggttcttggaccatgattacttagaaaacatgtatggaatgttcaaaaaagttaatgccagggaacgagtagtaggttggtaccacaccggccccaaacttcatcaaaatgatattgccattaatgagttaatcagaaggtattgtccaaattccgttctagttatcatagacgctaaaccaaaagatttaggtttaccaactgaagcttatcaagctgtagaagaagtacacgatgacggttcacctacatctaaaacatttgagcatgttcctagtgaaatcggagctgaggaagctgaagaagttggtgttgaacacttattgagagatattaaagacacaactgttggtactttgtcacagagaataacgaatcagcttttagggttaaaaggtctccattcacagttacgtgatattagggactatttggtacaagtgtgtggtaaccagcttccaatcaatcaccaaatcatctaccaattacaagacatatttaatcttttgcccgatataaatcaggatgc

SEQ ID NO: 11 - DNA, 1123 bp, Diabrotica virgifera
aacaataaattttattgcgatgatttctcacaagaaaaaataattttttatatacatataaacataaatatgaatatattttgagaaaaaaataaggtagtataactgaaacctaataattttctaaggattttaaaaaatatctgcttgacaaggatacaattagggtaacaacaaacttaactgtttaaaatacttcaaaaaaaggaatggtttattatatatatcgtatatacatagtagtttaaaaggtttttgaagatctgtctaagcaaccaacaatgttttacaatactatataaaatacaggcaatacacagtatccaaaaaatacttaatcagtgaattttctgttgacgttgcgtccgaacagagcattacggatctggggaatcaattgttgtgagatgagctcaagacgggcttccagagtattgttgattttgatcttgtttctcaaggccaacagttcgattcctccggtggtttcttgagaaaggtggctctcgtcgtcgatttttagatttacgtctttaccggttatgtccttgtacttttgggagacgttaggcatgatagattttaccaattctctgtcctgagggcgtactctaatggtgatgtccttttcgaagagctgatagagcccttggaggatgagactttccaggatttgtgtatatttgcctgaatctctggttacctcaccaagacgtttgcgagcatcttccaaaacggcacgtacatggtcttcccttactttcaataccttcaatcttgcctggttcaacatgtttgatgattggatttttttctggagttctacttgcttctcttttttctcgtagtactccataatcttgagcctctgttgttggaccagacggcccttttcgatgttgaattcttcttcagcctttgcatcaatttcctcggccttttcattggcttcttgctcaatgaaagccatcatgtgcttgatctgcttttgtacatctgcgtcgctgagagccattttgagcctttttctttcgacttagaggaaattaaagggatttaaacaatgtttttcccgactacgcccagcaactttctgaacaatttgctcaataaaaatcggacg

SEQ ID NO: 12 - DNA, 26 bp, Diabrotica virgifera
gacgttgcgtccgaacagagcattac

SEQ ID NO: 13 - DNA, 26 bp, Diabrotica virgifera
gttcagaaagttgctgggcgtagtcg

SEQ ID NO: 14 - DNA, 743 bp, Diabrotica virgifera
gacgttgcgtccgacagagcattacggatctggggaatcaattgttgtgagatgagctcaagacgggcttccagagtattgttgattttgatcttgtttctcaaggccaacagttcgattcctccggtggtttcttgagaaaggtggctctcgtcgtcgatttttagatttacgtctttaccggttatgtccttgtacttttgggagacgttaggcatgatagattttaccaattctctgtcctgagggcgtactctaatggtgatgtccttttcgaagagctgatagagcccttggaggatgagactttccaggatttgtgtatatttgcctgaatctctggttacctcaccaagacgtttgcgagcatcttccaaaacggcacgtacatggtcttcccttactttcaataccttcaatcttgcctggttcaacatgtttgatgattggatttttttctggagttctacttgcttctcttttttctcgtagtactccataatcttgagcctctgttgttggaccagacggcccttttcgatgttgaattcttcttcagcctttgcatcaatttcctcggccttttcattggcttcttgctcaatgaaagccatcatgtgcttgatctgcttttgtacatctgcgtcgctgagagccattttgagcctttttctttcgacttagaggaaattaaagggatttaaacaatgtttttcccgactacgcccagcaactttctgaac

SEQ ID NO: 15 - DNA, 2325 bp, Diabrotica virgifera
  modified_base (107)..(185): n = a, c, g or t/u
atcgtcatcgtccaaatccatagcaacattgggattcaaagccctctctctttctctcctaatttcggtttcgatgctctgcctgatggccagtttgcaagctctcntggcagatttcagtcaaatcnnggcacccagaaaatcccatgagttactttagcaatgtatacaagatctacgtcttntagctacaggcgatttcctcaagttggctttgaagatggcttccctagatttctcgtcgggtagagggatgtagatcaactgatcgagacgacctggacgcaatattgcaggatcgatgatatctggtctgtttgtagcaccgataataaacacgttctttttggctcccataccgtccatttctgttagaatttgattaataactctgtcggctgcaccaccggcatcacctacatttccaccacgcgatttggcaattgaatctaattcgtcaaagaatagaacacaaggtgccgcagatcgagccttgtcgaagatatctctgacatttgcttctgattcaccaaaccacatagtaagcaactctggtcctttaactgagataaagttggcttggcattcattcgcaatagccttagctaataacgttttaccgcaaccaggcggcccatagaacaacactcctctggacggttgcataccgaacttaaggaacttatctggatgttcgactgggtattgcaccaattcttgcaattctttcttgacattagccaagccaccgatatcgtcccaagtgacgtttggtacttctactatggtctcacgtaaagcacttgggctgctcttcgtcatggcgtaacggaagttctccatggtaactgccagtgagtttaggacttctgcgtcaatttggtcgtcttcgaggtcgatgaggtccattttttctctgatttgttgaagggctgcttccgaacacaatgaagctaaatcagcacctacgtgaccatgagtttccgcagcgatctgttccaagtcgacatcatcggccaatttcatgttcttggtgtgaatacgtaaaacttcaagtctgccagttgcatcaggtattccgatatcgatttccctgtcgaatcttccgaatctacgtaaagctggatcgattgagtttggtctgttagtagcggccataacgataacgtgggaactcttcttcataccgtccatcaaagttagaagttgggatactatacggcgttccacctctccgtgtgttttctctctcttgggagcgatggcatccaattcatcaatgaaaataatagctggggaattcttgtcggcttcctcgaaagctttacgaagattgctttcggattcaccggccaatttgctcataatctcaggaccgttaatcaagaagaagaacgctccagtttcgttagctacggcacgtgcaatgagtgtcttaccagtacccggtggaccgtaaagtaagatacctcttggtggtttaactccaatagccttgaaaagactaggatgtctcagtggtaactccaccatttctttgatttgagcgagctgttttctacaacctccgatgtcgtcgtatccaactgcgttaagagcttcttcctcctcttcgcgcttgattggatctccatcacaatgaatgacggtatctggagccactatacagtacggagcgggatcggtctcgacgactttgaattcaacagctctcattcctccacgtacaacgaatacgtcatctttgtgtattggtcgataggcctccaggaagtagggtttcaggtatacttcgaagagatttcctgtgagtccttccactgtatcatctatgggaagtacatgtattctcttgccatattttacatcagggcaagcttggatagaaactacatctgaaagcctaactcttaaattatttctaacatttctattcatacgaattttttcatcgctacatgtatcatcagataatactatacaaacagtttctttccttcgcttgcccttcagtaggactgtgtctcctctgaaaagttgtagttcatccatttttgcttgtgacaaagcaaccacggagttatcatcgttaactgcttcttctaccaaaagtctatttggacgatctttcttacggagaattgcggtggccaaatcctctggatttttgttttcggccattatttagtaatgaatatgtacttaatgtagaaacttttgaaaaatcagttcacaatagaaattatctcttttatatgatttcagtttttactcaagcacaaagatgacgatcgttattctgacacaaaatgacggacgcgtggg

SEQ ID NO: 16 - DNA, 26 bp, Diabrotica virgifera
tcgtcatcgtccaaatccatagcaac

SEQ ID NO: 17 - DNA, 26 bp, Diabrotica virgifera
ggaaactcatggtcacgtaggtgctg

SEQ ID NO: 18 - DNA, 978 bp, Diabrotica virgifera
tcgtcatcgtccaaatccatagcaacattgggattcaaagccctctctctttctctcctaatttcggtttcgatgctctgcctgatggccagtttgcaagctctctggcagatttcagtcaaatcggcaccagaaaatccatgagttactttagcaatgtatacaagatctacgtctttagctacaggcgatttcctcaagttggctttgaagatggcttccctagatttctcgtcgggtagagggatgtagatcaactgatcgagacgacctggacgcaatattgcaggatcgatgatatctggtctgtttgtagcaccgataataaacacgttctttttggctcccataccgtccatttctgttagaatttgattaataactctgtcggctgcaccaccggcatcacctacatttccaccacgcgatttggcaattgaatctaattcgtcaaagaatagaacacaaggtgccgcagatcgagtcttgtcgaagatatctctgacatttgcttctgattcaccaaaccacatagtaagcaactctggtcctttaactgagataaagttggcttggcattcattcgcaatagccttagctaataacgttttaccgcaaccaggcggcccatagaacaacactcctctggacggttgcataccgaacttaaggaacttatctggatgttcgactgggtattgcaccaattcttgcaattctttcttgacattagccaagccaccgatatcgtcccaagtgacatttggtacttctactatggtctcacgtaaagcacttgggctgctcttcgtcatggcgtaacggaagttctccatggtaactgccagtgagtttaggacttctgcgtcaatttggtcgtcttcgaggtcgatgaggtccattttttctctgatttgttgaagggctgcttccgaacacagtgaagctaaatcagcacctacgtgaccatgagtttcc

SEQ ID NO: 19 - DNA, 637 bp, Diabrotica virgifera
cccacgcgtccgcccacgcgtccgcggactaaaatgaagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggctttatgtatctgaaaaaacaactgttgtacaagaagaataacttgtatttttgaaataaatttaagtttatattt

SEQ ID NO: 20 - DNA, 31 bp, Diabrotica virgifera
ggaattacagtaaccactaagtcaagggtag

SEQ ID NO: 21 - DNA, 31 bp, Diabrotica virgifera
cagatacataaagcccatctaagaatttacg

SEQ ID NO: 22 - DNA, 499 bp, Diabrotica virgifera
ggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggctttatgtatctg

SEQ ID NO: 23 - DNA, 678 bp, Diabrotica virgifera
aaattcttttacggaagacacgttgagaggtgcatttgcaggatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatattaaaaattt

SEQ ID NO: 24 - DNA, 26 bp, Diabrotica virgifera
ctagcagcctctgttatgcgatgtgg

SEQ ID NO: 25 - DNA, 27 bp, Diabrotica virgifera
gcttcatcctccctcatgtagttctgc

SEQ ID NO: 26 - DNA, 554 bp, Diabrotica virgifera
ctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagc

SEQ ID NO: 27 - DNA, 927 bp, Diabrotica virgifera
ctttacgcgtccgatatttttcatagatttagttttaaatactgacaattaagatgccggaccatttaggagatgatatgcgaaaaataaaagaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaacgctgatacagatgatcccaaatacattataaacgttaaacagtttgccaaattcgtagtagatttggcagactctgtggcccctacagacatagaagaaggcatgagagttggagtcgaccgaaataagtatcaaattcatattcctctacctccaaaaattgatcccactgtgactatgatgcaagttgaggagaagcctgatgttacatacagtgatgttggtggctgcaaggaacaaattgaaaagttgagagaagttgttgaaacacctttactccatcctgaaaaatttgtaaaacttggtattgaaccaccaaaaggcgttctcctttttggcccccctggaactggtaaaactctttgtgctagagcagtagccaatagaacagatgcctgctttattcgtgtaattggttctgaactggttcagaagtacgtaggagagggagcaagaatggttagagaacttttcgaaatggctaggtctaagaaggcctgcttgatattctttgattgaattgatgccattggctggagccagatttgatgatggcgctgga

SEQ ID NO: 28 - DNA, 25 bp, Diabrotica virgifera
gaacagaaagaggagcccgaaaagg

SEQ ID NO: 29 - DNA, 31 bp, Diabrotica virgifera
gcatcaattcaatcaaagaatatcaagcagg

SEQ ID NO: 30 - DNA, 800 bp, Diabrotica virgifera
gaacagaaagaggagcccgaaaaggaaattaaagccctggatgaaggtgatatagcacttcttaaaacctatggacaagggcaatacacaaagacaattaaaacatgtgaagaagatatccaaacgataatcaaaagagtaaatgaattaactggtataaaagaatctgatactggtttagctccaccagctttatgggatttggcagctgacaaacaaaccttacaaaatgagcaacccttacaagtggcccgttgtacgaaaattatcaacgctgatacagatgatcccaaatacattataaacgttaaacagtttgccaaattcgtagtagatttggcagactctgtggcccctacagacatagaagaaggcatgagagttggagtcgaccgaaataagtatcaaattcatattcctctacctccaaaaattgatcccactgtgactatgatgcaagttgaggagaagcctgatgttacatacagtgatgttggtggctgcaaggaacaaattgaaaagttgagagaagttgttgaaacacctttactccatcctgaaaaatttgtaaaacttggtattgaaccaccaaaaggcgttctcctttttggcccccctggaactggtaaaactctttgtgctagagcagtagccaatagaacagatgcctgctttattcgtgtaattggttctgaactggttcagaagtacgtaggagagggagcaagaatggttagagaacttttcgaaatggctaggtctaagaaggcctgcttgatattctttgattgaattgatgc

SEQ ID NO: 31 - DNA, 831 bp, Diabrotica virgifera
attgaaaataatgtaatcaaccattacatttaatgtgttttggctgctaacctcttgtctctctcttcagcaatagacaatttgactccctttcctcttgggagggaaacgaaggccttagctcccttaccaataatgaaaacgttatttaacctagtagcaaatacatgaccattagcatctttaacatgcacaatatcaaaggatccaggatgacgttccctattgataactgtacctacacgacccaaatttcttcctccagtgatcatacataagtttccagattcgaacttaatgtagtctagaattttagatgtggcaatttccaattggatggtgtcattgactttgatgtttgggtcagggtatctgatggtacggccatcatgtgtcaccaagaatggaattccttttggtccagtttggactcttcgtactttgcagagtttgtattttgcttcttcagcggtaatacggtgaatggcaaatctacctttaacatcatagataagacggaagaattcaccagtcttctcaatagtaataacatccataaatcctgcaggatagttactgtctgttctgacttttccatcgactttaattaatctttgcataacaatttttgtgacttcactgttggtgagggcatactttagtctgtttcttaagaaaattactaatggtaaagattctctcaacttgtgaggaccggtggatggacggggggcaaatacacctcccaatttgtccaacatccatgctttgggtgcgtttaaacgcttcaaatgctttttaggtcctcgagccatcttgactttaaaaata

SEQ ID NO: 32 - DNA, 29 bp, Diabrotica virgifera
gtgttttggctgctaacctcttgtctctc

SEQ ID NO: 33 - DNA, 25 bp, Diabrotica virgifera
gcatggatgttggacaaattgggag

SEQ ID NO: 34 - DNA, 733 bp, Diabrotica virgifera
gtgttttggctgctaacctcttgtctctctcttcagcaatagacaatttgactccctttcctcttgggagggaaacgaaggccttagctcccttaccaataatgaaaacgttatttaacctagtagcaaatacatgaccattagcatctttaacatgcacaatatcaaaggatccaggatgacgttccctattgataactgtacctacacgacccaaatttcttcctccagtgatcatacataagtttccagattcgaacttaatgtagtctagaattttagatgtggcaatttccaattggatggtgtcattgactttgatgtttgggtcagggtatctgatggtacggccatcatgtgtcaccaagaatggaattccttttggtccagtttggactcttcgtactttgcagagtttgtattttgcttcttcagcggtaatacggtgaatggcaaatctacctttaacatcatagataagacggaagaattcaccagtcttctcaatagtaataacatccataaatcctgcaggatagttactgtctgttctgacttttccatcgactttaattaatctttgcataacaatttttgtgacttcactgttggtgagggcatactttagtctgtttcttaagaaaattactaatggtaaagattctctcaacttgtgaggaccggtggatggacggggggcaaatacacctcccaatttgtccaacatccatgc

SEQ ID NO: 35 - DNA, 3173 bp, Diabrotica virgifera
gtcaaccacctcaacaaagttaaggctaagttggaacaaaccttggacgaactcgaagactctttggaacgcgaaaagaaactccgtggtgacgtagaaaaatctaaacgtaaggttgaaggcgacttgaaactcacccaagaggctgtagctgacttggaacgcaacaagaaggaactcgaacaaaccatccaacgcaaagacaaggaaatctcatcactcactgccaaactcgaagacgaacaatccgttgttggtaaacaacaaaaacaagttaaggaactccaggctcgcattgaggaactcgaagaggaagttgaagctgaacgtcaagcccgtgctaaagctgagaaacaacgcgctgatttggcccgcgaattggaagaactcggcgaacgtcttgaagaagccggtggtgctacctcagcccaaatcgaactcaacaagaaacgtgaagccgaactcgccaaactccgtcgtgacctcgaagaatccaacatccaacatgaaggaactcttgctaacctccgcaagaagcacaacgacgctgtttctgaaatgggtgaacaaattgaccaactcaacaaactcaaagccaaggctgagaaagaaaagtctcaatacttcggtgaactcaatgacctccgtgcttcagtcgaccacttagccaacgaaaaggccgctatagaaaaggtatccaaacaattgggacaacaactcaacgacgtccaaggcaaacttgacgaaaccaaccgcactcttaacgacttcgatgccgccaagaagaagttgtctattgaaaactccgacctcctcagacaactcgaggaagccgaatctcaagtatctcaactcagcaagatcaaggtatcccttaccactcaattggaagataccaagagattggccgatgaagagagcagagaacgcgctaccctcctcggcaaattcagaaacttggaacacgacttggacaacatccgtgaacaagttgaagaagaagccgaagccaaggctgatatccaaagacaactcagcaaagccaacgctgaatctcaactctggcgccagaaatacgaatctgaaggagttgctcgctctgaagaactcgaagaagctaagaggaaactccaagctcgtcttgctgaggctgaagaaaccatcgaatctctcaaccagaaggttgtagctcttgaaaagaccaaacaacgtttggccactgaagtcgaagacttgcaactcgaagtcgaccgtgctaacgccattgccaatgctgctgagaagaaacaaaaggccttcgacaaaatcattggagaatggaaactcaaggttgatgacttggctgctgaactcgatgccagtcagaaagaatgcagaaactactccaccgaattgttcagacttaagggcgcctacgaagaaggacaagaacaacttgaagctgtccgccgtgaaaacaagaacctcgctgatgaagttaaggatctccttgaccaaattggagaaggtggccgcaacatccacgaaatcgaaaaggcccgcaagcgcttggaagctgaaaaagatgaactccaagctgctcttgaagaagctgaagctgctcttgaacaagaagaaaacaaagtacttcgtagccaacttgaactttctcaagtccgtcaagaaatcgacagacgtatccaagagaaagaagaagaattcgaaaacacccgcaagaatcaccaacgtgccctcgactccatgcaagcctcccttgaagctgaagccaaaggtaaggctgaggcccttcgcatgaagaagaagttggaagctgatatcaatgaattggaaatcgctttggaccacgctaacaaggccaacgctgaagcccaaaagaccatcaaacgctaccaacaacaacttaaggacacccaaaccgcccttgaagaagaacaaagagctcgcgatgaagcccgtgaacaacttggaatttcagaacgtcgtgctaacgctcttcaaaatgaacttgaagaatctcgcactcttctcgaacaagccgaccgtgctcgtcgccaagctgaacaagaattgggagatgctcacgaacaattgaacgatcttggagcccaaaacgcttccttgtctgccgccaagaggaaattggaaaccgaattgcaaaccctccactcagaccttgacgaacttctcaacgaagccaagaactccgaagagaaggccaagaaggctatggtagatgccgctcgtctcgctgatgaactccgcgctgaacaagaccatgcccaaacacaagagaaactccgtaaagctctcgaagctcaaatcaaggacctccaagtacgcttggacgaagctgaagccaatgcccttaaaggaggaaagaaggctattgccaaattggaacaacgtgttagagaattagaaaatgaattagacggtgaacaaaggcggcacgcggatgcccaaaagaacttgagaaagtctgaacgtcgtatcaaggaacttagcttccaagctgaagaagaccgcaagaaccacgagaggatgcaagacctcgtcgacaaactccaacaaaagatcaagacctacaagagacagatagaagaagccgaagaaatcgccgctttgaacttggccaaattccgtaaagcccaacaagagctcgaagaagccgaagaaagagccgacctcgccgaacaggccatcgccaaattccgtgccaagggacgttcaggatctgcagctagaggagccagtccagcgccccaaagacagcgccccaccttgggaatgggagacgctctaggtggtccattccccccaaggttcgacttagcacctgatttcgagtgaacatgcgcgctgtgttagaatcttaataaacaaacgaactgtttaggtcgcatcaaaaccaactctatgcgattttacttttattaattttttattttcgtttttgaatattagagttgtatgattccgtaaatgttcgagaaaaaggagaacgaagggagtattcagagacacgtatttaccaccaagacagccctttgatctcttcatttctcaaaatgccaattattttgttatgaaaatatgtaggttgtataatgatattgtatgtatgataatgttgtatgatataaggcaccaataaacataaaagttatattgtt

SEQ ID NO: 36 - DNA, 31 bp, Diabrotica virgifera
ggtttggatgctgaattataccgtctaggtc

SEQ ID NO: 37 - DNA, 25 bp, Diabrotica virgifera
ggtgatccttggtggctttgtcttg

SEQ ID NO: 38 - DNA, 672 bp, Diabrotica virgifera
ggtttggatgctgaattatacgtctaggtcacactaaggtcttcttccgtgctggtgtcttgggtcagatggaagaacttcgtgacgaccgtcttggcaagatcgtcacctggatgcaatcttgggtccgtggttatctctcaagaaaggaattcaagaaactgcaagaacaacgtttggccctccaagtgtgccaacgcaacttgcgcaaatacctcaaattgcgcacatggccatggtacaaattgtggcagaaggtcagacctctcctcaacgtcacccgtatcgaggatgagattgccaaacttgaagagaaagcccaaaaagcccaagaagccttcgagcgtgaagaaaaggccaagaaggaattagaagctctctatgccaagctcttagctgagaagaccgagttgttatctaacttggaaggagaaaagggatccctttccgaaactcaagaaagggccaacaaactccaagcccaaaagaacgacctcgagtctcaactttctgaaacccaagatcgtttgagccaagaggaagatgctcgcaaccagttgatgcaacaaaagaagaaactcgaacaagaaatgtccggtttcaagaaagacatcgaagatttggaactcaacctccaaaagtctgaacaagacaaagccaccaaggatcacc

SEQ ID NO: 39 - DNA, 1222 bp, Diabrotica virgifera
tgagctgttgaactcagtgactagaatcaaaaagtagttggagcaagcgttctatcgcaccctttcaaccgaacggcttggtcgagtacttttctgtacctacgaacccagaagaaaattcagtttgtgtgaaaagttcaataagttacaagcattatagtttaaagcgttaggttgattaataatatttaagtatatttttcttccttatctatacacacacgacattaagattaaagtataaagaacaactatatcgtatctttttctttttgttttttataaaatatttagtaacaggaaagcacaaaacatgcatatgagctctttagatttatacagtgaaatggacttaaagctataaactgcgctaccaactcgaccacctgatttgctatgtggtgattttaaaagccgtgaagtcgatacataggagtaaatatagagaagccgcctctacaaacaaaacaccgcctcccaaacggacagacgtctcacagactcctgtcgatttggacggcgatgtttcagcgacaggaaacaaaaatgtcttgctgttctaagatttttttgtaaatcgcgtatttctaaaagaccaggtgtcgagttgaagtagggtggtggtgacgcctagacgtcaacgaccattttcttgtggatatcggtgttgccgaccacgttgcaaaattcctcgaaggaaattttgccgtcttcatctttgtcggcgaacaggatggtcttgtcgacgatctgctggagctgagtgtccttcagattgtttccgaccatcattttgagaacctgaaatagttctccattagagatgtatccgtcattatccatatcgtagatccggaaagcaaatctaagcttggagagcttgtcaccctttacgctgaattgagacacaccctgaatgaattctttgaaatcgacttctccgttaccatcggcatcgaagatgtcaatcacacgttgaacgagcggattctgctgcagctccggcagagacatgaactcgtcgatgctgagggcccccgagttgtccagatctaattttctgaatcttttaccgagacgtcgaatttcgtcggcgtcaaagttagagcatagctccatgggcagagagctctcgttacccatggtctgctccaagtactctaacttctaattgatttatgattctttttaatgatcgacaaactgaggataaataatttac

SEQ ID NO: 40 - DNA, 26 bp, Diabrotica virgifera
cgtctcacagactcctgtcgatttgg

SEQ ID NO: 41 - DNA, 34 bp, Diabrotica virgifera
caattagaagttagagtacttggagcagaccatg

SEQ ID NO: 42 - DNA, 684 bp, Diabrotica virgifera
cgtctcacagactcctgtcgatttggacggcgatgtttcagcgacaggaaacaaaaatgtcttgctgttctaagatttttttgtaaatcgcgtatttctaaaagaccaggtgtcgagttgaagtagggtggtggtgacgcctagacgtcaacgaccattttcttgtggatatcggtgttgccgaccacgttgcaaaattcctcgaaggaaattttgccgtcttcatctttgtcggcgaacaggatggtcttgtcgacgatctgctggagctgagtgtccttcagattgtttccgaccatcattttgagaacctgaaatagttctccattagagatgtatccgtcattatccatatcgtagatccggaaagcaaatctaagcttggagagcttgtcaccctttacgctgaattgagacacaccctgaatgaattctttgaaatcgacttctccgttaccatcggcatcgaagatgtcaatcacacgttgaacgagcggattctgctgcagctccggcagagacatgaactcgtcgatgctgagggcccccgagttgtccagatctaattttctgaatcttttaccgagacgtcgaatttcgtcggcgtcaaagttagagcatagctccatgggcagagagctctcgttacccatggtctgctccaagtactctaacttctaattg

SEQ ID NO: 43 - DNA, 864 bp, Diabrotica virgifera
  modified_base (842): n = a, c, g or t/u
gtagcaaggactattgccagatcattttgtccagagctgtatggatcttcagctcttgaaacaacagaagtagataactggttaacgctttcccttggtccacttaataatagaagcgaagttaccggtgtcttagaaaccctaaataaagttttaggttcagttacttacttggttgctaaaagaattactgttgctgatttcattgtttttggtagcttatatacaaacaaacactggaatgatttaaccaaatctaaatcggcaccagttaatgttgttcgttggtacgactttctacatgcacaagaagctgttatgaacattttaaataacctaccccaagatgtagcagcttcgttgacacaagcagaaaaacaagttagtcaagagaaaaatactaatattggtaatcgaaatcaagagggaaaatttgtcgatttgccttttgcacagatgggtaaagttattgtcaggtttccaccagaagcatcaggttatttgcacatcggccacgccaaagctgcccttctcaaccaacactatcaggaagctttccaggggaaacttattttacgtttcgatgatactaatcctgccaaagaaaatgtgcattttgaaaacgttattctggaagatgtagcaatgttacagattaaacccgacatattcacatatacctcagattactttgaacttatgttagagttatgtgaaaaaatgatgaaagaaggaaatgcctatgtagatgatactgaaccagaggaaatgaaaactcaaagagaacaaaaaatcgagtcagtcaacaggaataatgatgttcagaagaatttgctatgtgngaagaatgaaaaaggtaccgag

SEQ ID NO: 44 - DNA, 28 bp, Diabrotica virgifera
caaggactattgccagatcattttgtcc

SEQ ID NO: 45 - DNA, 33 bp, Diabrotica virgifera
gattttttgttctctttgagttttcatttcctc

SEQ ID NO: 46 - DNA, 790 bp, Diabrotica virgifera
caaggactattgccagatcttttgtccagagctgtatggatcttcagctcttgaaacaacagaagtagataactggttaacgctttcccttggtctacttaataatagaagcgaagttaccggtgtcttagaaaccctaaataaagttttaggttcagttacttacttggttgctaaaagaattactgttgctgatttcgttgtttttggtagcttatatacaaacaaacactggaatgatttaaccaaatctaaatcggcaccagttaatgttgttcgttggtacgactttctacatgcacaagaagctgttatgaacattttaaataacctaccccaagatgtagcagcttcgttgacacaagcagaaaaacaagttagtcaagagaaaaatactaatattggtaatcgaaatcaagagggaaaatttgtcgatttgccttttgcacaggtgggtaaagttattgtcaggtttccaccagaagcatcaggttatttgcacatcggccacgccaaagctgcccttctcaaccaacactatcaggaagctttccaggggaaacttattttacgtttcgatgatactaatcctgccaaagaaaatgtgcattttgaaaacgttattctggaagatgtagcaatgttacagattaaacccgacatattcacatatacctcagattactttgaacttatgttagagttatgtgaaaaaatgatgaaagaaggaaatgcctatgtagatgatactgaaccagaggaaatgaaaactcaaagagaacaaaaaatc

SEQ ID NO: 47 - DNA, 1491 bp, Diabrotica virgifera
gtgagtagtgaaaaaatatggccggagcaatgttatttgaaagagccccgtctgtttcttctcaacacgagaagcttttaaaattatccagggattcagatgatgaagatcaaaatattgtcaataaagaacaagacatccttaatcttggtgagaaatataaaaaggagggcaaggcaaaggaactcgcagagcttataaaggccaccaggcctttttttgagtttaataagcaaagcaaaagctgctaaattggtaaggtctctagttgactacttcctagatttagaagctggtattggtatcgaagtacaactctgcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgttgtatgacaatatgttggagcagaacctttgcagaattattgaaccatattctagggtacaagtagagtatgtagcaaaaaccataaaactcccagtactacaagtagagaagaaattgtcacagatgattttagatgccaagtttcatggaattttggaccaaggcgaaggtgtcctcatagtattcgaagaaagtgcagtagacaaaacatatgaaatggccctagaaacgatccagagtatgagcaaagtagtagatactctttatcaaaaagcaaagaaattgtcataggtataatgtagccgagaatgttatgaaaataataaaatgactgtaaatttttcagaactagattttttgtagacactgtgtttatataacctatttaatttgcttttgttaattcttgtctttttaaggattcttataactcatagttttcggagcttgagggttttggatgtgatggagtttttttgttaatacagtatagatattttttaagatacttaaagcttatct

SEQ ID NO: 48 - DNA, 34 bp, Diabrotica virgifera
gcaaagaatgtatagaatgggcaaaggaagagag

SEQ ID NO: 49 - DNA, 30 bp, Diabrotica virgifera
ggttctgctccaacatattgtcatacaacg

SEQ ID NO: 50 - DNA, 675 bp, Diabrotica virgifera
gcaaagaatgtatagaatgggcaaaggaagagagaagaacttttctacgtcagtcccttgaagccaggctgattgctctttattttgacactggaatgtacagcgaagcgctacaactggaatcgaccttactgaaagagttaaaaaagttggatgacaaaaatttgttggtggaagtacaactacttgaaagcaaaacatatcatgctttaagtaatttaccgaaggctagagctgcactaacttcagcacgaaccacagctaacgctatctattgccctccaaagatgcaggcagctttagatttacaatccggagtattacacgctgcagatgagaaggatttcaaaacagcttattcttatttttatgaagcttttgaaggttttgatagtgttgaatccccaaaagccctcacagcccttaaatacatgcttttgtcaaaaatcatgataaacagtccggaagacgtccaacaaatcgttagtggtaaattggcctttaaatacgctggtcaagatatagaggctatgaaatcagttgcacaggctgcacacaaaagatcactagcagatttccaacaagctgtaaaacagtttaaacatgaattagaagatgatgttattgttagagcacatttaggaacgttgtatgacaatatgttggagcagaacc

SEQ ID NO: 51 - DNA, 942 bp, Diabrotica virgifera
gaagaacatacgtccagactccagacaaacctttcaacaaatttagaaaacatttatataaaaatatcaacagttctgcttcagaaatacataaaatgtaatttaacttaagtcttgtaagatatcaattgttacacacgcgctttggaacgatgacagagttttagtaattggttaatgagtttataaatcttcgtcatcatcgggcagtgcagtttctgaggcttctttaagatccttttcgatttgttgctgccattggggatccatctggacttctggaggaagcaaggcaggtgcagctacgaattctaagttgggatctccaatgagtttcctagccaaccacaagaagggtttttcaaagttgtagttggattttgcagagatgtcatagtattgtaaattcttcttcctatggaagacaatgctctttgccttaactttcctatctttgatgtcaactttgttaccacacaatacaattgggatattttcacaaactctaacaagatctctgtgccagtttggaacatttttgtaagtgactctagatgtaacatcaaacataattatggcacattgtccttggatgtagtatccatcacgcagaccaccaaacttttcttggcctgctgtgtcccatacgttaaaacgaatttgtcctctatttgtgtggaaaactaaagggtgaacttctactcctaaggttgctacatatttcttttcgaattcaccagtcatgtgtctttttacaaaggtagttttgccagtacctccatctccgaccaagacgcatttgaaggtgggcatatcttgttcgccagccatgattttttgaatttaaacttgtgaataaaaagtactaggaaacaccgatggcacaaaaaatcacggattacttcagcttggttccaaagtcgttagagttcacaatggcgt

SEQ ID NO: 52 - DNA, 22 bp, Diabrotica virgifera
cttcgtcatcatcgggcagtgc

SEQ ID NO: 53 - DNA, 26 bp, Diabrotica virgifera
cgtcttggtcggagatggaggtactg

SEQ ID NO: 54 - DNA, 605 bp, Diabrotica virgifera
cttcgtcatcatcgggcagtgcagtttctgaggcttctttaagatccttttcgatttgttgctgccattggggatccatctggacttctggaggaagcaaggcaggtgcagctacgaattctaagttgggatctccaatgagtttcctagccaaccacaagaagggtttttcaaagttgtagttggattttgcagagatgtcatagtattgtaaattcttcttcctatggaagacaatgctctttgccttaactttcctatctttgatgtcaactttgttaccacacaatacaattgggatattttcacaaactctaacaagatctctgtgccagtttggaacatttttgtaagtgactctagatgtaacatcaaacataattatggcacattgtccttggatgtagtatccatcacgcagaccaccaaacttttcttggcctgctgtgtcccatacgttaaaacgaatttgtcctctatttgtgtggaaaactaaagggtgaacttctactcctaaggttgctacatatttcttttcgaattcaccagtcatgtgtctttttacaaaggtagttttgccagtacctccatctccgaccaagacg

SEQ ID NO: 55 - DNA, 763 bp, Diabrotica virgifera
gtcatactcacggttgtttttgtaaaacttgtaggtaacgaattttcgtttttagtgaattaacaaaacaacagagtgattttccaacaagaataacttatttattagtttcattaatttgataaacaataaaatggatagacttcttcgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtttttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaaccgcgccaaactacatccaacttaggacatctacagaaaccatcagtccaggctttgattcatggtctcaatcggcattactactccatcagtattaattacagaaag

SEQ ID NO: 56 - DNA, 23 bp, Diabrotica virgifera
cgactaggaggtggaatgccagg

SEQ ID NO: 57 - DNA, 27 bp, Diabrotica virgifera
caaagcctggactgatggtttctgtag

SEQ ID NO: 58 - DNA, 564 bp, Diabrotica virgifera
cgactaggaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaaccgcgccaaactacatccaacttaggacatctacagaaaccatcagtccaggctttg

SEQ ID NO: 59 - DNA, 1156 bp, Diabrotica virgifera
cacaaattggagacaagttcgcgtctaggcacggacaaaagggaacgtgcggtatacaataccgtcaagaggatatgatttttagtgctgaaggtattacgccagacattatcattaatcctcacgctatcccctcccgtatgacgattggtcacttgatcgagtgcatccaaggtaaggtatcatccaataaaggagaaatcggtgatgctacacctttcaacgatgccgtcaacgtacagaaaatctccactttgttacaagaatatggttatcaactcagaggcaacgaagtaatgtacaacggccatactggacgtaagataaatgctcagattttcttaggacctacctattatcaaagattgaagcacatggtggacgataagattcattcaagagctagaggaccgttgcagattctcgtcagacagcctatggagggtcgtgcaagagacggcggtctacgtttcggtgagatggaacgagattgtcaaatttcacacggtgcggcacaattcttaagagagaggctgtttgaagtttccgatccttatagaatccatatttgcaacttctgtggtttgatagctatcgccaatttgcgtaacaacacctttgaatgtaagggttgcaaaaataagacgcagatatcgcaagttagactgccttatgctgcgaaattactgtttcaagagctaatgtcgatgaatatagcgccgagacttatggtactgtagtgtttttaagtaaataaataaatgtccttatctaagaggattttatattgaaataaaccattaaaattttcccaccacaccccaccaccaccacccacacaaaccaacaaacaaaaaaaaaacaaaggaagaaaaaacaaaacgggggggggcgctttaaagggatccaaggtttaaggcccgcggggaggggacagcctaaatctttttttataagggcccccaaaaattcaatttccccggggccgcgcttttttcaaacagcccggggacggggaaaaaacccctggggggtttccccaattttaatctcccctttggcaaaacccttcccccctttttttcccccccctggggggggaaaaaaaagaagaaaaaagggcccccgcccccccacaattctcccccctcctccc

SEQ ID NO: 60 - DNA, 25 bp, Diabrotica virgifera
gtctaggcacggacaaaagggaacg

SEQ ID NO: 61 - DNA, 27 bp, Diabrotica virgifera
gacaatctcgttccatctcaccgaaac

SEQ ID NO: 62 - DNA, 677 bp, Diabrotica virgifera
gtctaggcacggacaaaagggaacgtgcggtatacaataccgtcaagaggatatgatttttagtgctgaaggtattactccagacattatcatcaatcctcacgctatcccctcccgtatgacgattggtcacttgatcgagtgcatccaaggtaaggtatcatccaataaaggagaaatcggtgatgctacacctttcaacgatgccgtcaacgtacagaaaatctccactttgttacaagaatatggttatcaactcagaggcaacgaagtaatgtacaacggccacactggacgtaagataaatgctcagattttcttaggacctacttactatcaaagattgaagcacatggtggacgataagatccattcaagagctagaggaccgttgcagattctcgtcagacagcctatggagggccgtgcaagagacggtggtctacgtttcggtgagatggaacgagattgtcaaatttcacacggtgctgcacaattcttaagagagaggctgtttgaagtttccgatccttatagaatccatatttgcaacttctgtggtttgatagctatcgccaatttgcgtaacaacacctttgaatgtaagggttgcaaaaataagacacagatatcgcaagttagactgccttatgctgcgaaattactgtttcaagagc

SEQ ID NO: 63 - DNA, 1156 bp, Diabrotica virgifera; identical to SEQ ID NO: 59

SEQ ID NO: 64 - DNA, 25 bp, Diabrotica virgifera
gtctaggcacggacaaaagggaacg

SEQ ID NO: 65 - DNA, 27 bp, Diabrotica virgifera
gctcttgaaacagtaatttcgcagcat

SEQ ID NO: 66 - DNA, 677 bp, Diabrotica virgifera; identical to SEQ ID NO: 62

SEQ ID NO: 67 - DNA, 919 bp, Diabrotica virgifera
cggacgcgtgggttgggatttaacaaatacgtcgttctaaatttctaaaactgcatacaaaaaatccttaaaaaactagtgaagattactaaagtgcaatagatacaaaaacaatatttttacgtattcaccataataatataaacgtagaaaatgaatcccgagtatgattatttattcaaacttctgctgattggagattcaggagtaggaaaatcttgtcttctactgagatttgcagatgatacctacacagaaagctatattagtaccattggcgtagattttaaaatcaggacaatcgatttagatggaaagacaattaaattgcaaatttgggatacagcaggtcaggaaaggtttagaacgattacatcaagttattaccgaggagcacatggtattattgtagtgtacgattgcacagaccaagattcattcaataacgttaaacaatggctcgaagaaatcgaccgttatgcgtgtgacaatgtaaacaaattactggtagggaataaaagcgatttgacaactaagaaagttgtcgacttcactacagccaaggagtatgccgaccaattgggtataccatttttggaaacctcagctaagaatgcaaccaatgtagaacaggcctttatgactatggccgctgaaataaaaaatagagtaggacctccatcttctgcggtagaccaaggaaataaggttaggttcgatcaaagtcgcccagtcgaaacaaccaaatccggttgctgctgaaaatatttagttctctttggttgaaggtggtcactcatgtcatctcttttgtacggtagcagcgctacagttactcttattctagtaatatccgtctgtatgtatagttattttaaagtttttgtttgattttcacttttaaattttttttttcaaa

SEQ ID NO: 68 - DNA, 27 bp, Diabrotica virgifera
caaacttctgctgattggagattcagg

SEQ ID NO: 69 - DNA, 25 bp, Diabrotica virgifera
cttggtctaccgcagaagatggagg

SEQ ID NO: 70 - DNA, 521 bp, Diabrotica virgifera
caaacttctgctgattggagattcaggagtaggaaaatcttgtcttctactgagatttgcagatgatacctacacagaaagctatattagtaccattggcgtagattttaaaatcaggacaatcgatttagatggaaagacaattaaattgcaaatttgggatacagcaggtcaggaaaggtttagaacgattacatcaagttattaccgaggagcacatggtattattgtagtgtacgattgcacagaccaagattcattcaataacgttaaacagtggctcgaagaaatcgaccgttatgcgtgtgacaatgtaaacaaattactggtagggaataaaagcgatttgacaactaagaaagttgtcgacttcactacagccaaggagtatgccgaccaattgggtataccatttttggaaacctcagctaagaatgcaaccaatgtagaacaggcctttatgactatggccgctgaaataaaaaatagagtaggacctccatcttctgcggtagaccaag

SEQ ID NO: 71 - DNA, 755 bp, Diabrotica virgifera
cgttaatctagaaatcagtctttttatgttcagaggttgaaaataaaacctcaaaatggtaaacggtaggataccgtcggttcattctaaaacctatgtaacgcctaggcgtccatatgagaaggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaatcacctttgggaggcggtcgtccaggacgtgttaagaggaagaacctcaccaagaagagcggtggtggaggtgcagctgaagaagaggaagactaagctgtatgtcgtgctagttgtactagtacttacatattaatatacttatgtattaaaaaaaaaaaaaaaaaaaaaaaaaaaaaaaagaaaaaagaaaaaaaaaaaaaaaaaaaaa

SEQ ID NO: 72 - DNA, 31 bp, Diabrotica virgifera
gtttagatcaagaattgaaaatcatcggagc

SEQ ID NO: 73 - DNA, 21 bp, Diabrotica virgifera
gcacctccaccaccgctcttc

SEQ ID NO: 74 - DNA, 490 bp, Diabrotica virgifera
gtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaatcacctttgggaggcggtcgtccaggacgtgttaagaggaagaacctcaccaagaagagcggtggtggaggtgc

SEQ ID NO: 75 - DNA, 857 bp, Diabrotica virgifera
  modified_base (818): n = a, c, g or t/u
catctttctgtctgttcccggcgttctttgaaaaagttttcaataatactctaaaaaatggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtcatgatgttcagtgccaccttaagtaaagaaattagaccagtttgcaagaaatttatgcaagatcccatggaagtatatgttgacgacgaagctanattaacattgcatggtctacagcaacattatgtaaaact

SEQ ID NO: 76 - DNA, 34 bp, Diabrotica virgifera
gcagacgctgatgatctattagattatgaagatg

SEQ ID NO: 77 - DNA, 32 bp, Diabrotica virgifera
cttgaacatcacgtctcatgtctaataactcc

SEQ ID NO: 78 - DNA, 627 bp, Diabrotica virgifera
gcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagagtgatgttcaag

SEQ ID NO: 79 - DNA, 847 bp, Diabrotica virgifera
cccacgcgtccgtatctaaccaggcagctaaattaaacaactttactgataatgcagaactgtggctcttaaactacgaagacgatactttcaaagaccaagtacaagctttatgggagcaagtgaagcctttatacctagaacttcacgcctatgtgaggttcaagctaagacaaaaatacggagatgttgtcccggagaaaggacctattcctgctcatttgttaggaaatatgtgggcacaaacatggaacaatattgcaagcttcacattaccatatccagatgttgttgattatgatataactgcagaaatgttgaaacagaacttcacagcgaagaagatatttgaaacggccgaaagttttttcaagtccatcaatttaacagctatgcccgatctgttctggcagagatcaatcatagagaagccgaaggatagggaaatcgtttgtcatgcctcagcctgggacttctacgatggaaaggacttcaggatcaaaatgtgtactgacgttaattatgaggatatgaacacagctcaccacgaaatgggacacatagagtactttttacagtaccgcaatcagcctactccataccggactggagctaatgatggattccacgaagctgttggagacctgatttctttatcattcagttccaccaaacatttgcggaaaattggactaataacatccaaagctgataacaatgaacagcttctcaacaacttatacaagattggtttagaaaaaatcgcattcttgccatttcgatacttgatcgacttgtgccgatgggatatctttgcacgaaaaactactcctgaaaactaccaact

SEQ ID NO: 80 - DNA, 23 bp, Diabrotica virgifera
gcgtccgtatctaaccaggcagc

SEQ ID NO: 81 - DNA, 30 bp, Diabrotica virgifera
ggtggaactgaatgataaagaaatcaggtc

SEQ ID NO: 82 - DNA, 666 bp, Diabrotica virgifera
gcgtccgtatctaaccaggcagctaaattaaacaactttactgataatgcagaactgtggctcttaaactacgaagacgatactttcaaagaccaagtacaagctttatgggagcaagtgaagcctttatacctagaacttcacgcctatgtgaggttcaagctaagacaaaaatacggagatgttgtcccggagaaaggacctattcctgctcatttgttaggaaatatgtgggcacaaacatggaacaatattgcaagcttcacattaccatatccagatgttgttgattatgatataactgcagaaatgttgaaacagaacttcacagcgaagaagatatttgaaacggccgaaagttttttcaagtccatcaatttaacagctatgcccgatctgttctggcagagatcaatcatagagaagccgaaggatagggaaatcgtttgtcatgcctcagcctgggacttctacgatggaaaggacttcaggatcaaaatgtgtactgacgttaattatgaggatatgaacacagctcaccacgaaatgggacacatagagtactttttacagtaccgcaatcagcctactccataccggactggagctaatgatggattccacgaagctgttggagacctgatttctttatcattcagttccacc

SEQ ID NO: 83 - DNA, 928 bp, Diabrotica virgifera
  modified_base (750)..(835): n = a, c, g or t/u
cagatgtgtggtatgcacatcgtcgtacacgctgatgagttgcaagatttgattaattattatcaagatagaggatactttgaagaattaatcggcctattggaagcagcattgggcttggaaagggcacacatgggtatgttcaccgaattagcaattttgtattccaaatacaagcccgccaaaatgcgcgaacatctggaactcttctggtctcgagtgaatatccccaaagttcttagggcagctgaacaagcacatttgtgggcagagttagtgtttttgtatgacaaatatgaagaatatgataacgctgtgttagccatgatggctcatcccaccgaagcttggcgcgaaggtcatttcaaggatattattacaaaagttgccaatatcgaactttattatagagctattcaattttacttggattacaaaccgctgttgttaaatgaccttttgttggtgttggcacccaggatggatcatactagggctgtttctttctttacaaaaacaggacacttacagttggttaaatcctatctccggtctgtgcaaaatttgaacaacaaagctatcaacgaggccctcaactctctacttatcgaagaagaagacttccagggtctgagaacgtccatcgacgccttcgataacttcgacaacatcggcttggctcagaaattggagaagcacgaactgacggagttcagacgcatcgccgcctacttgtacaaaggcaacaanccggtggaagcagagcgtagaactgtgcaaaaaggatagactatttagagacgctatggagtacacttctgaatctagaaatcangaaattgccgaaagagtgctggcatgggtcttggataggaaggcctatgattgtttttcggcatgtttgtatccctgctacgacttgttacgg

SEQ ID NO: 84 - DNA, 25 bp, Diabrotica virgifera
gcacatcgtcgtacacgctgatgag

SEQ ID NO: 85 - DNA, 26 bp, Diabrotica virgifera
cgtgcttctccaatttctgagccaag

SEQ ID NO: 86 - DNA, 686 bp, Diabrotica virgifera
gcacatcgtcgtacacgctgatgagttgcaagatttgattaattattatcaagatagaggatactttgaagaattaatcggcctattggaagcagcattgggcttggaaagggcacacatgggtatgttcaccgaattagcaattttgtattccaaatacaagcccgccaaaatgcgcgaacatctggaactcttctggtctcgagtgaatatccccaaagttcttagggcagctgaacaagcacatttgtgggcagagttagtgtttttgtatgacaaatatgaagaatatgataacgctgtgttagccatgatggctcatcccaccgaagcttggcgcgaaggtcatttcaaggatattattacaaaagttgccaatatcgaactttattatagagctattcaattttacttggattacaaaccgctgttgttaaatgaccttttgttggtgttggcacccaggatggatcatactagggctgtttctttctttacaaaaacaggacacttacagttggttaaatcctatctccggtctgtgcaaaatttgaacaacaaagctatcaacgaggccctcaactctctacttatcgaagaagaagacttccagggtctgagaacgtccatcgacgccttcgataacttcgacaacatcggcttgtctcagaaattggagaagcacg

SEQ ID NO: 87 - DNA, 999 bp, Diabrotica virgifera
  modified_base (743)..(827): n = a, c, g or t/u
aaaaacgaagaaagtacgttaatatggttccagggctccaacaagacgagctattcttactgggtcgagaacattttaaaatttttggataagtactacgttcccagcaaaatagctaaaggaaatggccaaattaaaacatgctctcatcacgactatcctactagtggagaagtatgcgaagtcgatgtcagagattgggaagaatgcaacagggatcaattctttaattatcacaagaattctccatgtatttttattaaattgaacaaaatatataactgggagccaatgtattacgatgatccatacgatttacctgaggaaatgccggataatctgaagcaacatataaggggtatcaacaatactagagagttgagaaacgtttgggtctcatgtcaaggagaaaatcctgctgatgtagaatacttgggccccattacatactatccccgaagcgtacagggcttccctggttactattttccgtacttgaactctgaaggttacctaagtcctttagtagcagttaaatttgaaagaccagtggctggtatcgttattaacgtagagtgcagagcctgggcaaggaacatactttacaacagagccgatagaacgggctctgtgcatttcgagctgctaattgattaaatattattttacccaattggacaatagaagaatccttcaggactttttaattcaaatattatatagtaatagaaatgttgccttanaatanggggcttttataaaatagccgatcgatcacatanagtaagctataagaagtacattccaatatgaaccacccataccanatatttttatacattttataaatttatataacttttttaatcttactgaaatatccttttggcatccattgttgcaatttttgtttctagattaaaatatattgggttccatattatttttaaagggatgaataatttttggaaaagaaaaaaatttttgttttggtggggg

SEQ ID NO: 88 - DNA, 32 bp, Diabrotica virgifera
gaagaaagtacgttaatatggttccagggctc

SEQ ID NO: 89 - DNA, 24 bp, Diabrotica virgifera
gtatgttccttgcccaggctctgc

SEQ ID NO: 90 - DNA, 595 bp, Diabrotica virgifera
gaagaaagtacgttaatatggttccagggctccaacaagacgagctattcttactgggtcgagaacattttaaaatttttggataagtactacgttcccagcaaaatagctaaaggaaatggccaaattaaaacatgctctcatcacgactatcctactagtggagaagtatgcgaagtcgatgtcagagattgggaagaatgcaacagggatcaattctttaattatcacaagaattctccatgtatttttattaaattgaacaaaatatataactgggagccaatgtattacgatgatccatacgatttacctgaggaaatgccggataatctgaagcaacatataaggggtatcaacaatactagagagttgagaaacgtttgggtctcatgtcaaggagaaaatcctgctgatgtagaatacttgggccccattacatactatccccgaagcgtacagggcttccctggttactattttccgtacttgaactctgaaggttacctaagtcctttagtagcagttaaatttgaaagaccagtggctggtatcgttattaacgtagagtgcagagcctgggcaaggaacatac

SEQ ID NO: 91 - DNA, 1560 bp, Diabrotica virgifera
cggacgcgtgggaaacacatggatttcgtcgtctcgtcataagttgaaatacaagtgaaaatatttgtgatatttagttttagtgtgccaaaataaaaatggatgacgaccaacaattttgtttacggtggaacaaccatcaatcgacattggtagccgtttttgacacgttattggagaacggcacattagtagactgtactttggcagcagaaggaaaatgcctaaacgcacacaaagtagttttgtctgcatgtagtccatacttcgaggcgctgctgtcaaagcactttgacaagcatcccattcttattcttaaggacgttaagttccaagaactaaaagccatgatggactatatgtacaggggggaagtgaacatatctcaagatcaattaggcgcgcttttaaaagccgctgaatctttgcaaattaagggtttatcagacaataggaaaggggaaactgaacgaaaacccactcctgctcctccaccaaagagcccacagccaacgaccctgccgaaggtccagggtttgacaattgagcaaagagctcgggaggattccagggagggaagcatgtcaccagggcctcgaaaaaagaaaaggttaaggcggaaaagtgaggaattagacaaccacgatgcctctaattcttcagaatctcacagtctacccgcccaaagcattcctacgttacctgctatttcaaaaatgaacatgaacgccgatgtgcctgaacaaatagaaactaaatcagagatactcacaaggcataaacagacagatgacatgccccaagttcctattataaaagaaaagattgaaacccacacagaactgatgttggaaccaaagtctgaatatgtagaagaaatgaatgaagatagtattgaggatttgacactggatgatgacgatttaagtaatatggaacaggtagatgatcaagcaggacctagtcatggagcaggagaaggatcaagtcaaggttttggaggttggcatatgggtaaccaaagtcaagatgaagtatttctggccgcgcaagaggccgtaggtgcacatcgagactcacaaggtaagatttttgttttcaattgtaaaggcttgtctactgttctgcaactgacttgttaaaggagtgtatacttcaaccactcctttggtcatgagacctgttagtacttacaaactacaatggtagttgttgaagttctttacagtagacaagtttcattcacttgcaagtggtatggcaaaatttaacaccctgacttccagtctctggtttaacattttattttattttacctaacgggtagtccttggtttctcctgttgcttaacacttagctttttattttactagatgtagtagtagttatttttggttttacccatcacctttctccctccctcaagattgacagcactccttcatcaatttttcatttggaggtaccagccagccctacaggtcaacccaaaaccactagtattttaaatctaaattgttttgagagaagtttcatagatgataccttactattaataa

SEQ ID NO: 92 - DNA, 24 bp, Diabrotica virgifera
cgtgggaaacacatggatttcgtc

SEQ ID NO: 93 - DNA, 24 bp, Diabrotica virgifera
ggaacttggggcatgtcatctgtc

SEQ ID NO: 94 - DNA, 802 bp, Diabrotica virgifera
cgtgggaaacacatggatttcgtcgtctcgtcataagttgaaatacaagtgaaaatatttgtgatatttagttttagtgtgccaaaataaaaatggatgacgaccaacaattttgtttacggtggaacaaccatcaatcgacattggtagccgtttttgacacgttattggagaacggcacattagtagactgtactttggcagcagaaggaaaatgcctaaacgcacacaaagtagttttgtctgcatgtagtccatacttcgaggcgctgctgtcaaagcactttgacaagcatcccattcttattcttaaggacgttaagttccaagaactaaaagccatgatggactatatgtacaggggggaagtgaacatatctcaagatcaattaggcgcgcttttaaaagccgctgaatctttgcaaattaagggtttatcagacaataggaaaggggaaactgaacgaaaacccactcctgctcctccaccaaagagcccacagccaacgaccctgccgaaggtccagggtttgacaattgagcaaagagctcgggaggattccagggagggaagcatgtcaccagggcctcgaaaaaagaaaaggttaaggcggaaaagtgaggaattagacaaccacgatgcctctaattcttcagaatctcacagtctacccgcccaaagcattcctacgttacctgctatttcaaaaatgaacatgaacgccgatgtgcctgaacaaatagaaactaaatcagagatactcacaaggcataaacagacagatgacatgccccaagttca

SEQ ID NO: 95 - DNA, 1412 bp, Diabrotica virgifera
gaagtgacttctggcccgtcttgtgcaggttgttcagattcgcttcgaggagaagaatcgtcgctggcggttggattgtcgtttgcagtcgagtttgtttttgggttcttgctctgtgaattgtttttgttcctcacgaattttggcctccgaccatacggataacgttgggggctaggtttaggttttggctgaattgctttcttttcaggatcaaagaaatgatctaagatatccaacagctcttccagatctttatccttcgcatttgctacctcactcttaataactttttccaaaccatccttggcgtcagaatcataagcgattttaagtttgtcataattaatgttgttctctgccaaaagtctccttaaatggctcgcgtgctgcctctcagttcgactggcccgtaacagtgctccaaacactggccggaatgtattttgtctttctaataataccttaaaaagagctatttcctcttcctcagcatctataggattgacatatggacataccacttccatgagatgactttctgttccagtacaatctttactggctgcctctccctttaattcctctctttccccttgagctaaatgagcagcaatatcaaatgaagcccttgctctatctactgcactgttgaagtgctctgcacccctgtttaacaataccttagacattatatggagattgaaagatttcgtggtgttgccacattttgcttgggctatattgaagccattagcaaagccttttaccaccttttggaacctttcaatcatattatgtcttcttaatgattctaacagcatccccggtgaggctttgcgaagttcataataaatcaatataattccatcaacgtcatttcctttaacagtctccaaccatttcaagaagtcttggagagcagaaatttcactcttggtcttcaagaattcctgggtgttgacatctttcaaccttctgtagcggattgtgtttactactctgataccatgtcttctgctgtaggtaggattcaaatctccaaatggcatgacatactgtgaaaactgtgattcaggtgtaaacgcagctatttgaatgatttcatcaattagtctgcggccagtagtatctataccccatcctacaagcttgtattttccagtaggaataccctttgctggattttcaggaacaactggcactgaactctccctctcatcaccagagtttgcactctccttctgcaccatcataaattatttattatcacaaaaggctggccaaaataaattttataccatcacttttccaaaacttataatgacaatacaaaattaattattcataaaaaataacaattgcaatcggaatttataaataaaaattcaaagaaaattccgaaacacacg

SEQ ID NO: 96 - DNA, 23 bp, Diabrotica virgifera
gcaggttgttcagattcgcttcg

SEQ ID NO: 97 - DNA, 25 bp, Diabrotica virgifera
ggtggtaaaaggctttgctaatggc

SEQ ID NO: 98 - DNA, 750 bp, Diabrotica virgifera
gcaggttgttcagattcgcttcgaggagaagaatcgtcgctggcggttggattgtcgtttgcagtcgagtttgtttttgggttcttgctctgtgaattgtttttgttcctcacgaattttggcctccgaccatacggataacgttgggggctaggtttaggttttggctgaattgctttcttttcaggatcaaagaaatgatctaagatatccaacagctcttccagatctttatccttcgcatttgctacctcactcttaataactttttccaaaccatccttggcgtcagaatcataagcgattttaagtttgtcataattaatgttgttctctgccaaaagtctccttaaatggctcgcgtgctgcctctcagttcgactggcccgtaacagtgctccaaacactggccggaatgtattttgtctttctaataataccttaaaaagagctatttcctcttcctcagcatctataggattgacatatggacataccacttccatgagatgactttctgttccagtacaatctttactggctgcctctccctttaattcctctctttccccttgagctaaatgagcagcaatatcaaatgaagcccttgctctatctactgcactgttgaagtgctctgcacccctgtttaacaataccttagacattatatggagattgaaagatttagtggtgttgccacattttgcttgggctatattgaagccattagcaaagccttttaccacc

SEQ ID NO: 99 - DNA, 441 bp, Diabrotica virgifera
ggaaaagaagatcaaagtatatttaaaatagctaaaagggattcgccgacgaagacaatagtctcggatttgaagcctggtacaaggtatagattgtggttggaggtttacttgactaatggaaaaattaagactagtaacgtacaagattttatcaccaagcccagaactgcaccgtcgttgggcgcatcaacacaacaagataaactctccagagcggagcatcttgaacccaaaggagactactatggtcctctagtcattgtagcaatattagcagcgattgccatattgagtactttggtactattactgattttgattcgacgacataatcaaaacaaggctgccatcacaccaccatctcgaatcaatcagtctgcttatgataatccttcatataaggttgaaatacaacaggaaacaatgggtaaaggtttt

SEQ ID NO: 100 - DNA, 26 bp, Diabrotica virgifera
gattcgccgacgaagacaatagtctc

SEQ ID NO: 101 - DNA, 32 bp, Diabrotica virgifera
ctttacccattgtttcctgttgtatttcaacc

SEQ ID NO: 102 - DNA, 396 bp, Diabrotica virgifera
gattcgccgacgaagacaaagtctcggatttgaagcctggtacaaggtatagattgtggttggaggtttacttgactaatggaaaaattaagactagtaacgtacaagattttatcaccaagcccagaactgcaccgtcgttgggcgcatcaacacaacaagataaactctccagagcggagcatcttgaacccaaaggagactactatggtcctctagtcattgtagcaatattagcagcgattgccatattgagtactttggtactattactgattttgattcgacgacataatcaaaacaaggctgccatcacaccaccatctcgaatcaatcagtctgcttatgataatccttcatataaggttgaaatacaacaggaaacaatgggtaaag

SEQ ID NO: 103 - DNA, 2859 bp, Diabrotica virgifera
cgaagtgattcagtagtacctttaagtgattaagttttgttagttagggattgtaaattaagatacctacatgaaattggttctaatgcttgtggccgtccaggccgcggcggtattaacgtcaccgccgtcgacaccatccacaccgtcggcgccaccgtcgcttccaaccaattcgaagacttgcattgaccactgcacgtgcagctttggaatgctgaccaataggctgcaggtaaccaaatgcgataggcctctagtacttaacgacgccacttttaagtacattagcaagacctcaacgaacgtcatcacccttgacaatttgatcatcaaccagatccaagttagtgcattcgccgggttcaagaatcttgacgatgtcatcattaccaacacgagaattgcgactatagatgtgaaagccttcgagaatgtgacgcgcctaaagttctccaaatgtgcctttgaagacagtcctgacctcttctctacaaagttggaggaggtgcattttggtgaatgcaaattagaagaaattcccaatctaaatggactgatcaatctaacgtttttaaatttatcgggaaattacattaaaaacattgaagttgaagctttcgctgaactgtttgatctaggagagcttcatctttccgacaataacatccacaaactcccacctactgcgtttattaataaccaagaattaatcacccttaacctcgacaacaacccccttaaacattttaacattaatacatccgacagtttagagatattgtcacttaagaattgccaattagagacatttgacgaagaatcaacaaaaaaattaacttctcttaatgaattaaacctaagtcacaacaatcttacagacatattcagtaaagcattgtcccacatgcaggatctttcagtaattgacctttcttacaataagttgactaaacttcaagataatattttctctggaaacggtaaactcatcaaagttatcttagatggaaacaatttcgacaccttaccatctttctaccgccaaaaccatgaaagtttctctacttacacgttctcttgtaaatcttgtaacttacgaattctttcagccaacgtcttccagaatatggatggtttgattaatctggaactgtcacacaataagttaatgaatgtggataatgtcttcgacaaaattaccagcttgaaacaattagatatttcttataatgaaatttcatacttgtcgccagcagcttttgtacataacggcaatttagaaattttaaacattgctggtaatcctttactggttcttaatccagaagtgtttgccgcaaatcatcttcttagagatattgacgccagaaatgctactctaacaaaattgtggtccaactacaacaaacctgttaaatctttgcataaactgcttctaagtggaaacttcttaggaactctaaccaacgatgatttcaacatcatgcccaaattagaggcaatagaattggaagacaatcctttagtgtttgatgagaagttatgtatgttattatactttttagatcttcaaggcattactcctatcgattatagcaagaatatataccggagctgataaggcttttagggaagacattgatgattttgtaaccattgaatggaaagatgttcataaaggtaaatgtcctgaacatattactgagtctgctttacctgaactaactcgcatagataacaaaactacgtataaaactattgacaaaattgagaaagaagattatgaggaagacgatgacgacgacgatagcgattctgatgaatacgacgatgaatactacgacgaagaaacgactactaagttccaagacacatctcttgctagagccacttacatcttgtcagtaacttcagtatttgtattaagtgctttagtagtactgaccatagctgttaccttaactctatgcattctgcgcagaaacaaccgctttgacatgcaacgagctaacttaccaaggctgaaaattcctctttggaatacaactccaggtcaaaagaaacacagtgggtctgtatacagacctctttccgaagacctctcgggtcccaagactcctaaattgagtcgctatgaatttaatacaaccccagtagtgcatactgcttaaagttacttaaaattctgtggttcatagataaataagactattttgtttaatatgtatataatcaaattattgtctcttatgaaataagattagcgataaagtattcggctgactgcagtacggcagataacctagggaccaaatttccattacttctgtgaaccaaaaccatttttaagctttaatcgtcctggggactggagagttcgcattttgtgcactccgccatagataggtactgtcgaaaaatgttttgtgtatttttaaaataagacaatttgaaaattgatttttaccataccctttaaccgtttcctaacaattgcactaggtaaagatccattttcatgtactgaatttagactattgatttaaaatctacttaattttcaaattagaagcatgcactggtataccggtgcaatcgaactaagagctgaatattaatgactctcatagtttgattgcagaactatattgtcatgtcttagttctacgtaatttaactgtctataaatgttattgcgcttatagtatagaaaaatattgttaagccacagattaagcaggtattgtttgccatatgtacctaatatcagcagcattcagctcttcttaatatctgtaaactatctaatttctagttgtaatcaaaatgttttcaataaattttttatcggaaaaa

SEQ ID NO: 104 - DNA, 32 bp, Diabrotica virgifera
catcttcttagagatattgacgccagaaatgc

SEQ ID NO: 105 - DNA, 27 bp, Diabrotica virgifera
cagacccactgtgtttcttttgacctg

SEQ ID NO: 106 - DNA, 736 bp, Diabrotica virgifera
catcttcttagagatattgacgccagaaatgctactctaacaaaattgtggtccaactacaacaaacctgttaaatctttgcataaactgcttctaagtggaaacttcttaggaactctaaccaacgatgatttcaacatcatgcccaaattagaggcaatagaattggaagacaatcctttagtgtttgatgagaagttatgtatgttattatactttttagatcttcaaggcattactcctatcgattatagcaagaatatatataccggagctgataaggcttttagggaagacattgatgattttgtaaccattgaatggaaagatgttcataaaggtaaatgtcctgaacatattactgagtctgctttacctgaactaactcgcatagataacaaaactacgtataaaactattgacaaaattgagaaagaagattatgaggaagacgatgacgacgacgatagcgattctgatgaatacgacgatgaatactacgacgaagaaacgactactaagttccaagacacatctcttgctagagccacttacatcttgccagtaacttcagtatttgtattaagtgctttagtagtactgaccatagctgttaccttaactctatgcattctgcgcagaaacaaccgctttgacatgcaacgagctaacttaccaaggctgaaaattcctctttggaatacaactccaggtcaaaagaaacacagtgggtctg

SEQ ID NO: 107 - DNA, 2859 bp, Diabrotica virgifera; identical to SEQ ID NO: 103

SEQ ID NO: 108 - DNA, 30 bp, Diabrotica virgifera
cgacgccacttttaagtacattagcaagac

SEQ ID NO: 109 - DNA, 33 bp, Diabrotica virgifera
ctaagataactttgatgagtttaccgtttccag

SEQ ID NO: 110 - DNA, 740 bp, Diabrotica virgifera
cgacgccacttttaagtacattagcaagacctcaacgaacgtcatcacccttgacaatttgatcatcaaccagatccaagttagtgcattcgccgggttcaagaatcttgacgatgtcatcattaccaacacgagaattgcgactatagatgtgaaagccttcgagaatgtgacgcgcctaaagttctccaaaagtgcctttgaagacagtcctgacctcttctctacaaagttggaggaggtgcattttggtgaatgcaaattagaagaaattcccaatctaaatggactgatcaatctaacgtttttaaatttatcgggaaattacattaaaaacattgaagttgaagctttcgctgaactgtttgatctaggagagcttcatctttccgacaataacatccacaaactcccacctactgcgtttattaataaccaagaattaatcacccttaacctcgacaacaacccccttaaacattttaacattaatacatccgacagtttagagatattgtcacttaagaattgccaattagagacatttgacgaagaatcaacaaaaaaattaacttctcttaatgaattaaacctaagtcacaacaatcttacagacatattcagtaaagcattgtcccacatgcaggatctttcagtaattgacctttcttacaataagttgactaaacttcaagataatattttctctggaaacggtaaactcatcaaagttatcttag

SEQ ID NO: 111 - DNA, 464 bp, Diabrotica virgifera
  modified_base (313)..(407): n = a, c, g or t/u
caagctaaagatagatttctttcacaattaattagtgaaaatccatttgtagatataaatatatttttgaaattcaataaaattagaaaattaaactgtactctggatgatttacgaaaagcaattagcaagtcggatatgatagaactatcagaatgcaaagaaagaataaagagaaagatgcctataaaaattaatgaaaatgtagacaattgtacaatatatgttgaaaatattaaagccgatgctaaccatgagtgggtttcacagatattttcagaatttggaaatgtggtttatgtttccataccanaatacagacataatanaacaaacaaaggttttgcttttgttgagttcgaagatgaagctggtgctaaaaatgctcttacatactttgagagtantgggtgtaaaatgccatcagaaacaaacccggagaaattaaagagtatcagacattc

SEQ ID NO: 112 - DNA, 30 bp, Diabrotica virgifera
ctctggatgatttacgaaaagcaattagca

SEQ ID NO: 113 - DNA, 27 bp, Diabrotica virgifera
ggtttgtttctgatggcattttacacc

SEQ ID NO: 114 - DNA, 336 bp, Diabrotica virgifera
ctctggatgatttacgaaaagcaattagcaagtcggatatgatagaactatcagaatgcaaagaaagaataaagagaaagatgcctataaaaattaatgaaaatgtagacaattgtacaatatatgttgaaaatattaaagccgatgctaaccatgagtgggtttcacagatattttcagaatttggaaatgtggtttatgtttccataccaaaatacagacataataaaacaaacaaaggttttgcttttgttgagttcgaagatgaagctggtgctaaaaatgctcttacatactttgagagtattgggtgtaaaatgccatcagaaacaaacc

SEQ ID NO: 115 - DNA, 968 bp, Diabrotica virgifera
  modified_base (922): n = a, c, g or t/u
cttttaaacttgtttagtgatctcttcatttttaaatcggctgttaatgaaagactgtgatttttgtagttgttgtgatatcaaaatgaggcgtacttttggattactgctagtttttctaggattgtggacattgtgtatagcacaaacggaatattgtatgaccccaaggcaggaaggaggagattgcaaaataattacacaatgtccaagtttatttaaaattttaaaaaatcgtcctattagatctgaggacgcggattatttaagaaaatcacaatgtggtttcgaggggacgttaccaaaagtgtgctgtgctctgcaagaaactgttcaaactaccacgcagcgtcaagtagaatatgacacccctaaacctgcagatagtcccctgttaccatcaaaagaagactgcggtattggaagtataccagacaaaatttatggaggtaatacaacggatctcgatgaatttccatggatggccctccttgattacgaaaaagataatggtaatcacggattttattgtggaggagtactaattaactcacggtatatacttacagcagctcattgtgtcaaaggaaaagatttaccaagaaattggaaactagttggcgttaggcttggagaatataatttagaaacagacacagactgtgtacaaacagtaagtggtcaaaaatgtgcacctcctccagttaatgttgctgtagaagaacaaattgcccatgagcagtacaagccctacgatcaaaaccaataccatgacattgccttacttagacttgcaagaaatgtaaaaattaccggatttgttagacccatctgtcttccaaaaactgctgatgatcaatctagaaactacacagggcaaaaactaacagttgctggatggggtaaaacggaacacgatcgnaaagtaacataaaactcaaactagatgtaccaagtaaagctaatac

SEQ ID NO: 116 - DNA, 23 bp, Diabrotica virgifera
caaggcaggaaggaggagattgc

SEQ ID NO: 117 - DNA, 29 bp, Diabrotica virgifera
gatcatcagcagtttttggaagacagatg

SEQ ID NO: 118 - DNA, 690 bp, Diabrotica virgifera
caaggcaggaaggaggagattgcaaaataattacacaatgtccaagtttatttaaaattttaaaaaatcgtcctattagatctgaggacgcggattatttaagaaaatcacaatgtggtttcgaggggacgttaccaaaagtgtgctgtgctctgcaagaaactgttcaaactaccacgcagcgtcaagtagaatatgacacccctaaacctgcagatagtcccctgttaccatcaaaagaagactgcggtattggaagtataccagacaaaatttatggaggtaatacaacggatctcgatgaatttccatggatggccctccttgattacgaaaaagataatggtaatcacggattttattgtggaggagtactaattaactcacggtatatacttacagcagctcattgtgtcaaaggaaaagatttaccaagaaattggaaactagttggcgttaggcttggagaatataatttagaaacagacacagactgtgtacaaacagtaagtggtcaaaaatgtgcacctcctccagttaatgttgctgtagaagaacaaattgcccatgagcagtacaagccctacgatcaaaaccaataccatgacattgccttacttagacttgcaagaaatgtaaaaattaccggatttgttagacccatctgtcttccaaaaactgctgatgatc

SEQ ID NO: 119 - DNA, 542 bp, Diabrotica virgifera
cacaaaggaaacgaaagactggaacttcatggagaaactattcaaattccaaacgtaactcccgaaaatggaggtatatacagatgcttggccgacaatggcttaaaggaacccagtcacaaacacatcgccataaacattgaacatgcaccaaagatctcaatttccaagtacctagtaacatctaacaaagaaagagatgccgaattagtgtgtactgtagatgcctacccagatgcaatggttttttggaaaaaaggtgaccaaatcatgaaaaacgacgagaccaggaaagttatgactaagagaagacagcacaccattgaaagcatttttgtcatcaccaatctgactgacgatgacttcggtacctatacttgtgtgggcaagaatagaaatggtaagaaagaagagaaagtgagcttagtgaaaactcctgcagttagggatttcatcaaacctgtaaatgtcagcaaagacgtacttttgtcgtggaaagttgaatcgaaatcgcccatatcagcacatgaaattcagtacag

SEQ ID NO: 120 - DNA, 28 bp, Diabrotica virgifera
cacaaaggaaacgaaagactggaacttc

SEQ ID NO: 121 - DNA, 28 bp, Diabrotica virgifera
cacaaaggaaacgaaagactggaacttc

SEQ ID NO: 122 - DNA, 542 bp, Diabrotica virgifera
cacaaaggaaacgaaagactggaacttcatggagaaactattcaaattccaaacgtaactcccgaaaatggaggtatatacagatgcttggccgacaatggcttaaaggaacccagtcacaaacacatcgccataaacattgaacatgcaccaaagatctcaatttccaagtacctagtaacatctaacaaagaaagagatgccgaattagtgtgtactgtagatgcctacccagatgcaatggttttttggaaaaaaggtgaccaaatcatgaaaaacgacgagaccaggaaagttatgactaagagaagacagcacaccattgaaagcatttttgtcatcaccaatctgactgacgatgacttcggtacctatacttgtgtgggcaagaatagaaatggtaaggaagaagagaaagtgagcttagtgaaaactcctgcagttagggatttcatcaaacctgtaaatgtcagcaaagacgtacttttgtcgtggaaagttgaatcgaaatcgcccatatcagcacatgaaattcagtacag

SEQ ID NO: 123 - DNA, 2449 bp, Diabrotica virgifera
aaactcgtccataatcgcgatagttgagtgggtgaggttccaagagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaacgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatcattattgtt

SEQ ID NO: 124 - DNA, 28 bp, Diabrotica virgifera
gatagttgagtgggtgaggttccaagag

SEQ ID NO: 125 - DNA, 28 bp, Diabrotica virgifera
caagtacacgctgtcctgtaagcagagg

SEQ ID NO: 126 - DNA, 742 bp, Diabrotica virgifera
gatagttgagtgggtgaggttccaagagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaacgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttg

SEQ ID NO: 127 - DNA, 2014 bp, Diabrotica virgifera
  modified_base (1772): n = a, c, g or t/u
aggtattgcaggtacaccaggaaggagtattgtcggtgctaaaggtgataaaggtgaccaaggaccttctggtttagatggtttagcaggaatacaaggagaaaagggtgatgccggaaccccaggtttccctggagtgaaaggagataggggttacccaggtgaacaaggagcaccaggaatggacggctttccaggaaccaatggagaaaaaggtgatagaggatttgcaggagcgcccggttttacaggagagaaaggagaccgaggtttgtcaggtcttgatggatatgaaggacaaaaaggtgaaagaggccgaccaggttccaccggacccttcggcgaaccaggagaaaaaggtgacgtaggagaaacaggtcctccgggtccgttggtgcaaattaaaggagataaaggagaaccaggaccttttggattggaaggcagacagggtgaaaaaggagaccgtggattctctggagctattggtctacgaggagagaaaggggatgtaggtttccctggtgttaaaggaaatcttggtagcccagggcgtccaggagctaaaggtgaacgaggtctttctggggtagctggattaccagggttgacaatcaagggggagaaaggtttgcctggaatacctggcaaaaacggaagagaaggtatacctggcaccccagggcaaattggtgaaccaggattgccaggtttggacggcagacaaggaccacctggtccaccaggtccactgggtcttcaagggcagaagggagatcgaggttttgatggagctccaggaccacaagggccaaccgggcccccaggacagccaggattagaaggcgcccctggacaacgaggtgataagggagaaagaggtaaccccggtgctttcggagctccgggacaaaagggagatcgtggacaaacaggattgcaaggaatctcaggctatccgggagaaaaaggagacagaggttacgatggaacgcctggaattgaaggaccaatgggaccacctggtcttaaaggagatgctggtattccaggacaatctggaagaccgggtattccaggtcaaaagggtgacaaaggagagcgtgcacttcaaggaggtccaggtccaaaaggagatagaggttttcctggaaatcctgggttaccaggagagaggggacctgcaggtctcgacggaataccaggagttcacggacaaaagggagacaaaggtgagagaggattcactggtattgccggatcgcctggattacaaggagaaaaaggtgatataggtatcgaaggagcaataggacttcaaggttctatcggtgatatcggtccaaaaggtgaacctggtgcttcttgcgttgatgtccctgattatctcactggttctttactggttagacacagtcaaagtaaagaagttccaagctgcgaacgtggtcatatccaattgtgggaaggttattccttactatacgttgagggcaatgaaaaggctcatactcaagacttaggttacgctggctcctgtataaggaagttctcaacgatgccatttgtgttctgtgatgttaataacgtctgtaactacgcaagtagaaacgataaatcctactggctctccaccagtgcagctataccaatgatgcccgtagaggaatcgcagattgaggagtatatttcaagatgtgtcgtatgtgaagcacctgccagtgtcattgccgtgcacagtcaatctctagcacttccagaatgcccatacnggatggagttccttatggatcggctacagttttgtaatgcacactgcagccggagccgaaggtggaggtcaatctctttccagtcccggttcatgtttagaggacttcagggccacaccgttcatcgaatgtaacggtgctcaaggatcatgtcactatttcgccaacacccttagtttctggctcgcgaccatcgacaacaaccaacaattccagaaacctcagaaacagacactcaaagc

SEQ ID NO: 128 - DNA, 24 bp, Diabrotica virgifera
gtgaacaaggagcaccaggaatgg

SEQ ID NO: 129 - DNA, 24 bp, Diabrotica virgifera
ccaggcgttccatcgtaacctctg

SEQ ID NO: 130 - DNA, 838 bp, Diabrotica virgifera
ccaggcgttccatcgtaacctctgtctcctttttctcccggatagcctgagattccttgcaatcctgtttgtccacgatctcccttttgtcccggagctccgaaagcaccggggttacctctttctcccttatcacctcgttgtccaggggcgccttctaatcctggctgtcctgggggcccggttggcccttgtggtcctggagctccatcaaaacctcgatctcccttctgcccttgaagacccagtggacctggtggaccaggtggtccttgtctgccgtccaaacctggcaatcctggttcaccaatttgccctggggtgccaggtataccttctcttccgtttttgccaggtattccaggcaaacctttctcccccttgattgtcaaccctggtaatccagctaccccagaaagacctcgttcacctttagctcctggacgccctgggctaccaagatttcctttaacaccagggaaacctacatcccctttctctcctcgtagaccaatagctccagagaatccacggtctcctttttcaccctgtctgccttccaatccaaaaggtcccggttctcctttatctcctttaatttgcaccaacggacccggaggacctgtttctcctacgtcacctttttctcctggttcgccgaagggtccggtggaacctggtcggcctctttcacctttttgtccttcatatccatcaagacctgacaaacctcggtctcctttctctcctgtaaaaccgggcgctcctgcaaatcctctatcacctttttctccattggttcctggaaaaccgtccattcctggtgctccttgttcac

SEQ ID NO: 131 - DNA, 771 bp, Diabrotica virgifera
ggcaatgatttgtctgcgaaaatttttgcaaccatggaaaaacataaagaagtgttctttgtcattaggttacattctgtacagtctgctgctagcttaaagccaattcaggatcctgatccttttataaactgtgatttaatggatggtcgagatgcattcctaacactcgcccgtgaaaaacattatgaattctcttctttaagaagggccaaatatagtactttgtctatgttatatgaattgcataatcaaggtcaagataaatttgtatatacttgtaatagttgtaaagcccatgtggaaacaaggtatcattgtactgtgtgtgaagactttgacttgtgcatccaatgttatgagaaagaaggtcatcctcacaaaatggagaaacttggattggatattgatgatggaagttcacctagtgatagcaaagccaatccaggagaagctagaaaattatctatacagcgttgtatccattctttggtacatgcttgtcaatgcagagatgccaattgtcggttaccaagctgtcagaagatgaaacgagtcacaaatcacaccaaattgtgcaagaggaaaacaaatggtggttgccctatttgcaaacaactcatcgctctatgttgctatcatgccaaacactgcccagaaaacaagtgtcctgtaccattctgttcatgcataaagcacaaactaaaacaacaacaattgcaacaaaggttgcaacaggtgcaactacttagtataagaatggtagttatg

SEQ ID NO: 132 - DNA, 22 bp, Diabrotica virgifera
gcattcctaacactcgcccgtg

SEQ ID NO: 133 - DNA, 27 bp, Diabrotica virgifera
ggacacttgttttctgggcagtgtttg

SEQ ID NO: 134 - DNA, 515 bp, Diabrotica virgifera
gcattcctaacactcgcccgtgaaaaacattatgaattctcttctttaagaagggccaaatatagtactttgtctatgttatataaattgcataatcaaggtcaagataaatttgtatatacttgtaatagttgtaaagcccatgtggaaacaaggtatcattgtactgtgtgtgaagactttgacttgtgcatccaatgttatgagaaagaaggtcatcctcacaaaatggagaaacttggattggatattgatgatggaagttcacctagtgatagcaaagccaatccaggagaagctagaaaattatctatacagcgttgtatccattctttggtacatgcttgtcaatgcagagatgccaattgtcggttaccaagctgtcagaagatgaaacgagtcacaaatcacaccaaattgtgcaagaggaaaacaaatggtggttgccctatttgcaaacaactcatcgctctatgttgctatcatgccaaacactgcccagaaaacaagtgtcc

SEQ ID NO: 135 - DNA, 1120 bp, Diabrotica virgifera
atttagcccaaaatgtctgaagaaagtgaaaaaaactcgttggaaaaagttagtgaagtcgatggaagtacggacggaataatattaaataaaagtgcaaagaaacgtaacaaaaataaaaagaaaaagaatgaaaaccaagaagaaaacagtgaccaaagcaacgaggttgtccaagccgaaaacaacttattatctaacttatcgaaccctattaatacaatatcaattaaggagctaaaagcagccatggaggtatttactctatcacaaaaacctgccaagagttcagaggaagctctaaagaagacattccagttttggaatacccagcctgttcccaaaatggacgaaaaaataactgttaacgaagccattgaaccagacaaagaacctgctgacattagacaagaaccgtacagtttgcctgatggttttatgtgggacactcttaatctagatgaaccgttggtgctcaaagagttatatacgttactcaatgaaaactatgttgaagatgacgattgtatgtttagatttgattatcaacctgaatttttgaaatgggctttgcaacccccagggtggaagcgagaatggcattgtggagtcagagttgtaaaaagtggtagattagtgggatttatctctgcaattccagcaactctaaacatttataaaaagacacaaagaatggtggagataaattttctatgtgtacataaaaagctacgttccaaacgagtcgcaccagtgttgattcgagaaatcacccgcagagtacacctgaacggcctatttcaagcagtgtacaccgccggcatagtcctaccgaaaccagtgagtacttgtacctactggcatcgatcgctgaatccgaaaaaattaatcgaggtgaagttttctcatttgtctcgtaatatgacgctgcaacggactctcaagttgtacaaactgccggacaagcctaagactccgggatttagaaaaatgacagccgaagatatacctcaagctcacaaattactagtagagtatttaagtcgattcgacctagcgccatattttaacgaagaagagttcacacattggttcctacctagaacgaacataatcgaca

SEQ ID NO: 136 - DNA, 24 bp, Diabrotica virgifera
gtgaccaaagcaacgaggttgtcc

SEQ ID NO: 137 - DNA, 31 bp, Diabrotica virgifera
gtaggtacaagtactcactggtttcggtagg

SEQ ID NO: 138 - DNA, 707 bp, Diabrotica virgifera
gtgaccaaagcaacgaggttgtccaagccgaaaacaacttattatctaacttatcgaaccctattaatacaatatcaattaaggagctaaaagcagccatggaggtatttactctatcacaaaaacctgccaagagttcagaggaagctctaaagaagacattccagttttggaatacccagcctgttcccaaaatggacgaaaaaataactgttaacgaagccattgaaccagacaaagaacctgctgacattagacaagaaccgtacagtttgcctgatggttttatgtgggacactcttaatctagatgaaccgttggtgctcaaagagttatatacgttactcaatgaaaactatgttgaagatgacgattgtatgtttagatttgattatcaacctgaatttttgaaatgggctttgcaacccccagggtggaagcgagaatggcattgtggagtccgagttgtaaaaagtggtagattagtgggatttatctctgcaattccagcaactctaaacatttataaaaagacacaaagaatggtggagataaattttctatgtgtacataaaaagctacgttccaaacgagtcgcaccagtgttgattcgagaaatcacccgcagagtacacctgaacggcctctttcaagcagtgtacaccgccggtatagtcctaccgaaaccagtgagtacttgtacctac

SEQ ID NO: 139 - DNA, 940 bp, Diabrotica virgifera
cgtcaggttggtcaattcagtattcagaatagtagaattttgaattttctgtacgtgtacgtgagtcgtgagtgaatcgtatcgtatcgtggtatcgtatccggtccggttagctaagaatgtgtcaaacagggaagtttttaaattgttaatttagaagttaattttttgattaagttatacctaagtgcgaaattttcaaaaatgggccaacacgtatctagaacagatttcgaatgggtatataccgaggaacctcacgctagccgcaggaagcaaatcttagaaaaatatccccaaatcaagaaactctttggatacgatccgaacttcaaatgggtcgtaacgagcatggtacttacacaattcgtacttctgtacttactcaaagataggtcatggccagtgctaattttagtagcgtattgcttaggaggtgtcatcaatcactcgttaatgttggctatacatgaaatttcccacaatttggcgtttggacacgcacggccgttgcacaataaattatttggattttttgccaatttgccaataggattaccgattactataagctttaaaaaataccacttggaacaccacagatatcaaggtgacgaacagaaagatacggacatcccaacgtacatagaggccaaactattttgcacgacctttggaaaattcatttgggtgatactgcaaccgtttttctactctttccgcccactcgtagtttatccgaagccgcctacgcttttggaattcgtaaacctggtaattcaactcgccttcgatgctctcgttgtttattttttcggaggaagaatgttgggatatctccttattggatctgtcatggctatgggtcttcatccggtagcgggacacttcatcagtgaacattacatgttcaaaaagggctacgaaacgtacagctact

SEQ ID NO: 140 - DNA, 34 bp, Diabrotica virgifera
gtcaggttggtcaattcagtattcagaatagtag

SEQ ID NO: 141 - DNA, 27 bp, Diabrotica virgifera
ggataaactacgagtgggcggaaagag

SEQ ID NO: 142 - DNA, 746 bp, Diabrotica virgifera
gtcaggttggtcaattcagtattcagaatagtagaattttgaattttctgtacgtgtacgtgagtcgtgagtcgtgagtgaatcgtatcgtatcgtggtatcgtatccggtccggttagctaagaatgtgtcaaacagggaagtttttaaattgttaatttagaagttaattttttgattaagttatacctaagtgcgaaattttcaaaaatgggccaacacgtatctagaacagatttcgaatgggtatataccgaggaacctcacgctagccgcaggaagcaaatcttagaaaaatatccccaaatcaagaaactctttggatacgatccgaacttcaaatgggtcgtaacgagcatggtacttacacaattcgtacttctgtacttactcaaagataggtcatggccagtgctaattttagtagcgtattgcttaggaggtgtcatcaatcactcgttaatgttggctatacatgaaatttcccacaatttggcgtttggacacgcacggccgttgcacaataaattatttggattttttgccaatttgccaataggattaccgattactataagctttaaaaaataccacttggaacaccacagatatcaaggtgacgaacagaaagatacggacatcccaacgtacatagaggccaaactattttgcacgacctttggaaaattcatttgggtgatactgcaaccgtttttctactctttccgcccactcgtagtttatcc

SEQ ID NO: 143 - DNA, 1049 bp, Diabrotica virgifera
gtataaatatttataaaatacaatggctaagtttcacttaagaaaaaagtctaaacgacagccagcgcgtctcagatataagattgaaaagaaagtccgagagcacaacagaaaactcaagaaagaaaataagaacaaccctaaaaagaaaaaggaaataatgcaaatcccaaacatatgtccttttaaagaggacattcttaaagaagtagaagcactaaagaaacaaaaggaagaagaaaaacttaagctaagagaagctgcaaaattggaaaggcaaaaggagaaagaggaaagtaaaaaagagaaacttactgcaggacttcagggattagtgcaaaatgctgaactaaggagtaaacttcatgaacatttaacaccagataataatgtaaaacagcacgagacaaataatgagcagtccctgaaacaatattacaaagagtttaagaaggttatcgaagctgcagatgttattctagaagtagttgacgctagagatcctttagggactagatgtaagcaagtagagcaggctgtgttagatacaaaaggtaataaaagactagtcttagtattaaacaaggcagacttagttcctagagaaattttggatcaatggctaaagtacttgaagaaaaccactcccactatagcattcaaagcatcaactcaaaatcaaagtaaaaagttaggacagagaaagcttggaaagggaaataaggtattgcagagttcaaattctgtaggagcagaattgttaatgtctctgctagcaaactattgtaggaacaagggtatcaaaacttctataagagttggaattgtaggtttgcctaatgtaggaaaaagttcaattattaacagcttaaaaaggtctagagcttgtaatgttggtgcaacacctggtgttactagggcaatgcaggaagtacaattagactcaaagataaaacttttggattctcctggtatagtttttgcatctggaaatgacagtagtgcttctttgagaaatgcagttcgaatttctgccttgagtgatcctg

SEQ ID NO: 144 - DNA, 35 bp, Diabrotica virgifera
gtctcagatataagattgaaaagaaagtccgagag

SEQ ID NO: 145 - DNA, 30 bp, Diabrotica virgifera
gctttgaatgctatagtgggagtggttttc

SEQ ID NO: 146 - DNA, 598 bp, Diabrotica virgifera
ttctcagatataagattgaaaagaaagtccgagagcacaacagaaaactcaagaaagaaaataagaacaaccctaaaaagaaaaaggaaataatacaaatcccaaacatatgtccttttaaagaggacattcttaaagaagtagaagcactaaagaaacaaaaggaagaagaaaaacttaagctaagagaagctgcaaaattggaaaggcaaaaggagaaagaggaaagtaaaaaagagaaacttactgcagaacttcagggattagtgcaaaatgctgaactaaggagtaaacttcatgaacatctaacaccagataataatgtaaaacagcacgagacaaataatgagcagtccctgaaacaatattacaaagagtttaagaaggttatcgaagctgcagatgttattctagaagtagttgacgctagagatcctttagggactagatgtaagcaagtagagcaggctgtgttagatacaaaaggtaataaaagactagtcttagtattaaacaaggcagacttagttcctagggaaattttggatcaatggctaaagtacttgaagaaaaccactcccactatagcattcaaagc

SEQ ID NO: 147 - DNA, 889 bp, Diabrotica virgifera
gtaaaatagtttcaaaatgcatcaggaggccatacaactcatccaggtgctagaaaaaacagtttcaccggataaaaatgaattggaacaagcgtcatcgtttctcgaacaagctgcagtgactaacctactagaattcatcaaaactctatcagatatattaagacatggcggaaatagccctgtggcccgaatggccgcaggtttgcagttaaaaaatcaactcacctctaaagactccaacataaagaccacctaccaacaacggtggttggctttcccagaggacgttcgggggtatattaaaaataacgttgtgtgcgcacttggaaccgaaacaagcagaccatcatccgcagctcagtgcgtagcatacgtcgcagtaacagaactaccacaagggcaatggccagatctcatagcaacgttggtcaacaatgtttgccatgcaaattccacagaaatgcaaaaggaagccacattagaagctatcggttatatatgccaagaaatcgactcggacgtattagtatctcaaccaaacgacatcttaacagctatagttcatggaatgcgagcctcggaaccgagcaaccacgttcgtttagcagctacacaggccctattaaactctctagaattcacaaaggccaactttgaccaaccgacggaacggaactatatcatggaagtcgtctgtgaagccacgcagtctccagattcacagatcagagtggccgctttgcagtgtctagttaagattatgtctttgtattatcaacacatggaaccttatatggctcctgctctattccctatcactctagaagccatgaagtcggaaaaacgatgctgtttctctacagggtatcgaattctggtctaacgt

SEQ ID NO: 148 - DNA, 26 bp, Diabrotica virgifera
gccatacaactcatccaggtgctaga

SEQ ID NO: 149 - DNA, 31 bp, Diabrotica virgifera
gtgatagggaatagagcaggagccatataag

SEQ ID NO: 150 - DNA, 792 bp, Diabrotica virgifera
gccatacaattcatccagtgctagaaaaaacagtttcaccggataaaaatgaatggaacaagcgtcatcgtttctcgaacaagctgcagtgactaacctactagaattcatcaaaactctatcagatatattaagacatggcggaaatagccctgtggcccgaatggccgcaggtttgcagttaaaaaatcaactcacctctaaagactccaacataaagaccacctaccaacaacggtggttggctttcccagaggacgttcgggggtatattaaaaataacgttgtgtgcgcacttggaaccgaaacaagcagaccatcatccgcagctcagtgcgtagcatacgtcgcagtaacagaactaccacaagggtaatggccagatctcatagcaacgttggtcaacaatgtttgccatgcaaattccacagaaatgcaaaaggaagccacattagaagctatcggttatatatgccaagaaatcgactcggacgtattagtatctcaatcaaacgacatcttaacagctatagttcatggaatgcgagcctcggaaccgagcaaccacgttcgtttagcagctacacaggccctattaaactctctagaattcacaaaggccaactttgaccaaccgacggaacggaactatatcatggaagtcgtctgtgaagccacgcagtctccagattcacagatcagagtggccgctttgcagtgtctagttaagattatgtctttgtattatcaacacatggaaccttatatggctcctgctctattccctatcac

SEQ ID NO: 151 - DNA, 685 bp, Diabrotica virgifera
tccccttccccgcgtccgcagcatatgctatacggatcatgccgaagcgattcaaccaggctgatagagctataaatatggcctgcaagactggaagatgggtcatgctgaagaacgtacacttggctcctcaatggttagtccagctggagaagaagcttcattcacttcaacctcacgccaactttagactattcctcaccatggaaattaatccgaaactaccagttaatcttcttagagcaggaagaatatttgtattcgaacctccaccgggtattagagctaacctcttgagaacattcaacacagttccagtcagtaggatgatgaaagcaccaaacgaaacagcaagactttacttcttattggcgtggttccacgcgattgtccaggagaggttgatatattgccctctaggttgagcaaaacattatgaatttagtgaatcatatttaagagtcgcctgcgatactttggatacttggattgataccacggctatgggaatgactaacttgccggcagagaaactctcatgtgacaccctagccactctgctctcgcaatccatctatggtggtaaaatcgataacgattccgatcaacgactgttacattccttcctgaatctgctttttactcccataagctttgaaagcgactttcgcttcaagtccaacat

SEQ ID NO: 152 - DNA, 23 bp, Diabrotica virgifera
ggatcatgccgaagcgattcaac

SEQ ID NO: 153 - DNA, 27 bp, Diabrotica virgifera
gaatgtaacagtcgttgatcggaatcg

SEQ ID NO: 154 - DNA, 588 bp, Diabrotica virgifera
gatcatgccgaagcgattcaaccaggctgatagagctataaatatggcctgcaagactggaagatgggtcatgctgaagaacgtacacttggctcctcaatggttagtccagctggagaagaagcttcattcacttcaacctcacgccaactttagactattcctcaccatggaaattaatccgaaactaccagttaatcttcttagagcaggaagaatatttgtattcgaacctccaccgggtattagagctaacctcttgagaacattcagcacagttccagccagtaggatgatgaaagcaccaaacgaaagagcaagactttacttcttattggcgtggttccacgcgattgtccaggagaggttgagatattgccctctaggttgggcaaaacattatgaatttagtgaatcagatttaagagttgcctgtgatactttggatacttggattgatacaacggctatgggaaggacgaacttgccgccagagaaagtcccatgggacgccctagtcactctgctctcgcaatccatctatggtggtaaaatcgataacgattccgatcaacgactgttacattc

SEQ ID NO: 155 - DNA, 946 bp, Diabrotica virgifera
  modified_base (802)..(849): n = a, c, g or t/u
atccgaacatcctgacttggtaaaattaagatctgtgggaaaatctgtaagaaatagggatttgtgggctttagaaataaattctaatgtccaaaacaggacattgttaacaccaatgtttaaatatgttgctaatatgcatggggatgaagccataggaagacagttgatgatttacctggctctctatttaattcacaattatggcactaatgatagggtgaccagattggttaattcaactgatatttatttaatgccttcaatgaaccctgatggttatgaaaattcagaagagggcagatgtgaatctaaaaaacaatatgttggaagagaaaatgaaaatagtgttgatttaaatagagattttccagatcagtttgatgctacaaaagcaggaacaattctgtctggtaggcagcctgaaacgatagctatgatgacttggattatttccagaccatttgttttatctggaaatttgcacggaggtgcagtagtagctagctatccgtatgatgattctaactctggtcgaagatgctgtgtagagagtagatcaccagataataatattttcaaaacgttagcattaaactacgctcaatcgaatcctgtgatgaaaaagggtaatgcttgtaaagacgatacatttgatcagggcatcacaaatggtgctttttggtatgaagtgagaggtggcatgcaagacttcaactacgttcactccaactgtttcgaagtaacttttgaactgagttgctgtaaatttccgttagccaaaactctacctcaggaatgngcaacaacaaggaagccctactaactttcatggagtcaacacattgnggcgctaagggattggttagaaacgaaaacggtgacgccgttttggacgccgacgtagtggttgtgggtattacacataacgtcactacatccaacc

SEQ ID NO: 156 - DNA, 30 bp, Diabrotica virgifera
ctgtaagaaatagggatttgtgggctttag

SEQ ID NO: 157 - DNA, 28 bp, Diabrotica virgifera
gttggagtgaacgtagttgaagtcttgc

SEQ ID NO: 158 - DNA, 689 bp, Diabrotica virgifera
ctgtaagaaatagggatttgtgggctttagaaataaattctaatgtccaaaacaggacattgttaacaccaatgtttaaatatgttgctaatatgcatggggatgaagccataggaagacagttgatgatttacctggctctctatttaattcacaattatggcactaatgatagggtgaccagattggttaattcaactgatatttatttaatgccttcaatgaaccctgatggttatgaaaattcagaagagggcagatgtgaatctaaaaaacaatatgttggaagagaaaatgaaaatagtgttgatttaaatagagattttccagatcagtttgatgctacaaaagcaggaacaattctgtctggtaggcagcctgaaacgatagctatgatgacttggattatttccagaccatttgttttatctggaaatttgcacggaggtgcagtagtagctagctatccgtatgatgattctaactctggtcgaagatgctgtgtagagagtagatcaccagataataatattttcaaaacgttagcattaaactacgctcaatcgaatcctgtgatgaaaaagggtaatgcttgtaaagacgatacatttgatcagggcatcacaaatggtgctttttggtatgaagtgagaggtggcatgcaagacttcaactacgttcactccaac

SEQ ID NO: 159 - DNA, 658 bp, Diabrotica virgifera
gccgtggacttagcgggctgcgggatgatcgtgatctcgtcattgatcttcagaggtttcaactgatctgcagccgacggcttgggagagctgttggaagttgtcgaagaggtcgtggagccgcccttcttgtccatgactcgcttggcgacgacgctgtgggcggaatagacgtggttctcgaattgtttgtacattccgaaggtggccgtgcacactgtgcatttgtaggacaggtgcgcgggtttcaacgtcatgttatgatcccgggccacgtggtttagtaatttccattggtagactcttccacaaacaggacaccttcctgaatctttgctcttgttggcagcatcctgcatgctggaggtgactaatccatgagagcctaataaatgcctttccaacccttgatctgtgaagaacctaaattgacacttttgacaatttaatggcggcctgttatatatcatcttgggatgaatcttaatcttgtgtatccattgcatgtgatttctaagctgttcaaggtccttgatgtacccatcgcagatctcgcagatgacgaacgagttcttggaggatgtatcccctggtttggcgccgcccgaagatccaggtgcggctgcggcagcagatggggactagttctagatcgcga

SEQ ID NO: 160 - DNA, 21 bp, Diabrotica virgifera
gacttagcgggctgcgggatg

SEQ ID NO: 161 - DNA, 28 bp, Diabrotica virgifera
gatacatcctccaagaactcgttcgtca

SEQ ID NO: 162 - DNA, 580 bp, Diabrotica virgifera
gacttagcgggctgcgggatgatcgtgatctcgtcattgatcttcagaggtttcaactgatctgcagccgacggcttgggagagctgttggaagttgtcgaagaggtcgtggagccgcctttcttgccatgactcgcttggcgacgacgctgtgggcggaatagacgtggttctcgaattgtttgtacatgccgaatgtggccgtgcacactgtgcatttgtaggacaggtgtgcgggtttcaacgtcatgttatgatcccgggccacgtggtttagtaatttccattggtagactcttccacaaacaggacaccttcctgaatctttgctcttgttggcagcatcctgcatgctggaggtgactaatccatgagagcctaataaatgcctttccaacccttgatctgtgaagaacctaaattgacacttttgacaatttaatggcggcctgttatatatcatcttgggatgaatcttaatcttgtgtatccattgcatgtgatttctaagctgttcgaggtccttgatgtacccatcgcagatctcgcagatgacgaacgagttcttggaggatgtatc

SEQ ID NO: 163 - DNA, 888 bp, Diabrotica virgifera
  modified_base (771): n = a, c, g or t/u
cttattttatggtgtcgtgccagcagaaaattttaaaaattcttgtaattgtttagacatttcgcaacaattgtgaacaattttggaaaatattgcttgaaagctataattctagatgtaagagcaaagttttgtagtcaaaatggctggagtattcgatttagaactgcatgatgttgaaactgtagaagtagatgattcagacgatgcaatcgaaattgaagaggatgaatatgatcaaaatcctaatattaatgcaattgtagaatccgatgatacagaaacggttcatctgactgaacaaattgtgaatccgggccaggaaaaaaccggaccccatgactttgaattacgcaaagtcctgggcaaaggaggttatggcaaagtatttcaagttagaaaaattacggggaaagatgccaatactgtctttgccatgaaggttctccgcaaggcttccatagttagaaatcaaaaagatactgcccatacgaaagcagaacgaaatattttagaagaagttaagcatccttttatagtggatttgatatatgccttccaaacgggtggaaaattgtacttaattttagaatacctcagcgggggcgaactttttatgcatttagaaagagaaggaatatttttagaggataccgcttgcttttatttatccgaaatcattctcgccctagaacatttacatggacaaggaattatttatagagatctaaagcctgaaaatattttacttgacgcccacggtcacgttanattgacagatttcggtctgtgtaaaaacacattaacgaaggcatattgacccacaccgttttgtggaactattgaatatatggcacctgaaatttaactagacatggccatggaaaa

SEQ ID NO: 164 - DNA, 33 bp, Diabrotica virgifera
gcatgatgttgaaactgtagaagtagatgattc

SEQ ID NO: 165 - DNA, 27 bp, Diabrotica virgifera
gtgtgggtcaatatgccttcgttaatg

SEQ ID NO: 166 - DNA, 658 bp, Diabrotica virgifera
cttatgttgaaactgtagaagtagatgattcagacgatgcaatcgaaattgaagaggatgaatatgatcaaaatcctaatattaatgcaattgtagaatccgatgatacagaaacggttcatctgactgaacaaattgtgaacccgggccaggaaaaaaccggaccccatgactttgaattacgcaaagtcctgggcaaaggaggttatggcaaagtatttcaagttagaaaaattacggggaaagatgccaatactgtctttgccatgaaggttctccgcaaggcttccatagttagaaatcaaaaagatactgcccatacgaaagcagaacgaaatattttagaagaagttaagcatccttttatagtggatttgatatatgccttccaaacgggtggaaaattgtacttaattttagaatacctcagcgggggcgaactttttatgcatttagaaagagaaggaatatttttagaggataccgcttgcttttatttatccgaaatcattctcgccctagaacatttacatggacaaggaattatttatagagatctaaagcctgaaaatattttacttgacgcccacggtcacgttaaattgacagatttcggtctgtgtaaagaacacattaacgaaggcatattgacccacac

SEQ ID NO: 167 - DNA, 886 bp, Diabrotica virgifera
  modified_base (805): n = a, c, g or t/u
cgtttactaaacgtaaacgaataaaacaataaaagtacaatgaaaattatttaaataagaacataagtatttcagtatggatcgaccaagtacaagtaagcgaaatgtctttgactccgattcagatagtgtcgacagcactgaagaagctcgccgaagagatctgaaggaaagagatgaattcgcaaataggctcaaaaaacgcgatgaagaacgtactagaaacgttgccagtacttctgataagcgcgcttatgaagaggctgctaaaagacttaaattggacaatgcagaaaaagagaaacttattcctgcactcagagttgcttccaggaggaagtatttggagaagagaaaggaggacaaactacaagaattggaagctgatattgccgatgatgagtacctttttgaggaagatgttttgactgaaagagagaaaaaagatcgtgtacacaagaaagagctgttaaaattggcgcaggaacatgaaaaggccagggaacttgagcgggttcaaaggtatcacatgcccagagatttgggcaaggactccactgctgattacattgaagttgatgacttggagaaggtaccacaatctgaacagaagaaatgggaaaaagatcagatggcctcggcagtgtttaagtttggagcaaaagatgggattaaaaaagaagagtatgagttagtgttagaagatcaaattcagtttatacaagcactacaaatgccaggagtgtctgataagaaagaacccgaactaacggaaacagaaaagaaaaaacttactatagaaganacaaagaaaagccttccgatatacccttttaaagacgacttaatacaggccattagggaacaccaagttttgattatcgaa

SEQ ID NO: 168 - DNA, 31 bp, Diabrotica virgifera
cgaccaagtacaagtaagcgaaatgtctttg

SEQ ID NO: 169 - DNA, 31 bp, Diabrotica virgifera
gttctttcttatcagacactcctggcatttg

SEQ ID NO: 170 - DNA, 679 bp, Diabrotica virgifera
cgaccaagtacaagtaagcgaaatgtctttgactccgattcagatagtgtcgacagcactgaagaagctcgccgaagagatctgaaggaaagagatgaattcgcaaataggctcaaaaaacgcgatgaagaacgtactagaaacgttgccagtacttctgataagcgcgcttatgaagaggctgctaaaagacttaaattggacaatgcagaaaaagagaaacttattcctgcactcagagttgcttccaggaggaagtatttggagaagagaaaggaggacaaactacaagaattggaagctgatattgccgatgatgagtacctttttgaggaagatgttttgactgaaagagagaaaaaagatcgtgtacacaagaaagagctgttaaaattggcgcaggaacatgaaaaggccagggaacttgagcgggttcaaaggtatcacatgcccagagatttgggcaaggactccactgctgattacattgaagttgatgacttggagaaggtaccacaatctgaacagaagaaatgggaaaaagatcagatggcctcggcagtgtttaagtttggagcaaaagatgggattaaaaaagaagagtatgagttagtgttagaagatcaaattcagtttatacaagcactacaaatgccaggagtgtctgataagaaagaac

SEQ ID NO: 171 - DNA, 910 bp, Diabrotica virgifera
accaaaattataacccaggaaggatattgaaaatattcagaacttttaggaacccagaaggacgcgaattcacccgcgtagaatacgtccggaagcaagtcgtgatagacgcctacgtcaaaattcgtatgaccaaagacgaagaattcataagacagttcgctacgttagacgaagcgcagaaggaagagatgaagagagagaagcgacggatacaggagcaactgaggcggatcaagagaaaccaagagaaggaaaagatgggaggtgggcatacgcatatgcattcgacgcctatcgtaccgcctgcagggactgcgattgaaaagttgccaaatccaagtgactctctttcgacacctgttacaccaacttctagtaagagtatgtcctcgtctcctcctaaatcaaggaggaaaaccaaactcaagccagatctcaaactcaagtgtggagcctgtggaaatgtcggccatatgagaacaaacaaagcctgccctctttatcaagccacaactggtcagaacccgcctattaacgttgccatgactgaagaacaagaagaagatatcgagaagcaaattaatacagacgatgaagatctcgtaaacgtagatggaaccaaagttaaattgtctggaaagttgttgaagaattactttcagcatgccgaggagattaagcgtaggagcttaatgttaaaagtccctaaggacgctttaggtaaccgaaaaagaagaagaggggtgcaagatttacattgtgattatttgaagaaacacaacaggccagcgaatagaagacgaacggatccggttgtcgttttgtctactattttagagaatatactcaatgaaatgcgagatatgccagacgtccagccttttcttattccctgtcaatcaaaaac

SEQ ID NO: 172 - DNA, 27 bp, Diabrotica virgifera
cagaacttttaggaacccagaaggacg

SEQ ID NO: 173 - DNA, 25 bp, Diabrotica virgifera
gatccgttcgtcttctattcgctgg

SEQ ID NO: 174 - DNA, 776 bp, Diabrotica virgifera
cagaacttttaggaacccagaaggacgcgaattcacccgcgtagaatacgtccggaagcaagtcgtggtagacgcctacgtcaaaattcgtatgaccaaagacgaagaattcataagacagttcgctacgttagacgaagcgcagaaggaagagatgaagagagagaagcgacggatacaggagcaactgaggcggatcaagagaaaccaagagaaggaaaagatgggaggtgggcatacgcatatgcattcgacgcctatcgtaccgcctgcagggactgcgattgaaaagttgccaaatccaagtgactctctttcgacacctgttacaccaacttctagtaagagtatgtcctcgtctcctcctaaatcaaggaggaaaaccaaactcaagccagacctcaaactcaagtgtggagcctgtggaaatgtcggccatatgagaacaaacaaagcctgccctctttatcaagccacaactggtcagaacccgcctattaacgttgccatgactgaagaacaagaagaagatatcgagaagcaaattaatacagacgatgaagatctcgtaaacgtagatggaaccaaagttaaattgtctggaaagttgttgaagaattactttcagcatgccgaggagattaagcgcaggagtttaatgttaaaagtccctaaggacgctttaggtaaccgaaaaagaagaagaggggtgcaagatttacattgtgattatttgaagaagcacaataggccagcgaatagaagacgaacggatc

SEQ ID NO: 175 - DNA, 365 bp, Diabrotica virgifera
ggacgcgtggggtcaagtgaagttatattaaatatatttataataatttatcctatcgtcatcatgagaagtttaatagttgccacgattgtacttttcgccgtttatcaggcagtagatggtctcattgcctgtcacgaaaccttttgcgacaatcaaaaatgtacagaaaacctcgtttgcaaagattctgaagttctggttcccaagggaaccatttgcggatgttgcgacgactgctacagaaaactaaatgaaggcgatgcttgcaggtcacgttttattggaggaggtccattcagaggaaaatgtgtagatggattagtatgtaacgctgaaggaaaatgcgccaaagcctaaattat

SEQ ID NO: 176 - DNA, 29 bp, Diabrotica virgifera
cgtttatcaggcagtagatggtctcattg

SEQ ID NO: 177 - DNA, 30 bp, Diabrotica virgifera
gcattttccttcagcgttacatactaatcc

SEQ ID NO: 178 - DNA, 247 bp, Diabrotica virgifera
cgtttatcaggcagtagatggtctcattgcctgtcacgaaaccttttgcgacaatcaaaaatgtacagaaaacctcgtttgcaaagattctgaagttctggttcccaagggaaccatttgcggatgttgcgacgactgctacagaaaactaaatgaaggcgatgcttgcaggtcacgttttattggaggaggtccattcagaggaaaatgtgtagatggattagtatgtaacgctgaaggaaaatgc

SEQ ID NO: 179 - DNA, 870 bp, Diabrotica virgifera
acgcgtgggttcgtatttttttcttaacaaaagggcaaaatgagcttttttggaaaattgttcggggggaaaaaggaagagatagcccctagtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgaattagaaaaagaattagaagagctcgaacaagaaggattggaagaagacctgctccaagtgccaggtccaactcaactgccggctgtgcctgctgatgcagttgctactaaaccaatcaaaccagcagctaaaaaagttgaagatgatgacgatatgaaagaattggaagcctgggcctcgtaaaattcctgaaatctggatatttgtaaacgaaatcacccatctaagatgaaaacattataaatatataggtaataacagctaaaaacgtttcaatgtagaacaagcttttgctgaaaaggcgtcttgcaaaaaatgttgataatttagaattctctatatattatatat

SEQ ID NO: 180 - DNA, 26 bp, Diabrotica virgifera
gtcctggggaggctattcaaaaactc

SEQ ID NO: 181 - DNA, 29 bp, Diabrotica virgifera
caggcttccaattctttcatatcgtcatc

SEQ ID NO: 182 - DNA, 601 bp, Diabrotica virgifera
gtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgaattagaaaaagaattagaagagctcgaacaagaaggattggaagaagacctgctccaagtgccaggtccaactcaactgccggctgtgtctgctgatgcagttgctactaaaccaatcaaaccagcagctaaaaaagttgaagatgatgacgatatgaaagaattggaagcctg

SEQ ID NO: 183 - DNA, 860 bp, Diabrotica virgifera
  modified_base (804): n = a, c, g or t/u
acgacaaagtaacatataattaattataaacactgttttattgaaattacaaaactaaacttatcctaaaaatgatttgtaagcttatgtatatccgtaaggtcttcaataagttcttccattttagtaccaattttttgaaacctctgacttttctgttagcgaaaggtttaggaaattccacactaactccccatcgattatagatctagcagggttgttttgtagttttctccaacttttaaatgtcctgaaagccttgggatttaggccggcaatatgagctccttgggaaactaatacattttgcaacataagtaaacggcgatatgttttctctggaactggcataatgtatcctatacctccatccaaagtagcaaacattgtaataaaccttctatctgctccagaaaaatgctttttatcatcgcctagttcacctagtttacatttaattttaaagaatgtgttgacagtttggcctaaatggaaatccgctttccttaatagtctttgacctcctaaagattctcttgattctggttgatacatatacatggctagattttgttctccatctgatactaaaaatcctagtgatgaattatctatcatgtattctattgaatatacttcgtttggtttgaaatccctagataccattgacagtgttcggtactcttcttgaaaccttaacaacgcgatagatttgtagacatcaccaaccaacagcaaacttttgatagtaagtatttgatgagtatagacttgtgtatctataaatgctactccaataaatcngtatctttgagttgccaaatatatatcttttgtcccactgctgacacaggaaacct

SEQ ID NO: 184 - DNA, 32 bp, Diabrotica virgifera
ctctggaactggcataatgtatcctatacctc

SEQ ID NO: 185 - DNA, 31 bp, Diabrotica virgifera
ctgttggttggtgatgtctacaaatctatcg

SEQ ID NO: 186 - DNA, 399 bp, Diabrotica virgifera
ctctggaactggcataatgtatcctatacctccatccaaagtagcaaacattgtaataaaccttctatctgctccagaaaaatgctttttatcatcgcctagttcacctagtttacatttaattttaaagaatgtgttgacagtttggcctaaatggaaatccgctttccttaatagtctttgacctcctaaagattctcttgattctggttgatacatatacatggctagattttgttctccatctgatactaaaaatcctagtgatgaattatctatcatgtattctattgaatatacttcgtttggtttgaaatccctagataccattgacagtgttcggtactcttcttgaaaccttaacaacgcgatagatttgtagacatcaccaaccaacag

SEQ ID NO: 187 - DNA, 816 bp, Diabrotica virgifera
ggtcagctgtgtacgggagttgaagtcgagaaatgcgccttaggcatgtaagtgtggctgtcggagacactcaaagacagcaacatgtacgtatacggtttcgacattacatagacgtgtaatatgcgtgcgagtgcttgatcacggtgaagttctggcgtgaacggtggctcggaggaatcatggcgtcggtggcgggctcgcaagaacagccgcccgccgcgcacggccatagcttctgcaagaagaccttccacaagcccacctactgccaccactgcagcgacatgttatggggcctcatccagcagggcttcatctgcgaagtttgcaacttcgtagtgcatgatcgctgcttaaggactgtggtatccccgtgttccagcgtctccgccagtcaaataagaaatccggttgcacactgttggtcggagtcgtttcaccataaaagaaaattttgcaacgtatgtagaaaacggttagatgacagcgaatccattcattgcgaaatttgtgagtatttcgtacatgtggagtgccaggattttgcagtagctgactgtaaagaaaatgcaacttatcttccgggaaaacaacttaccttcgtgcgtcatcaacatcactggcgcgaaggaaatcttccaagcaattcccaagtgtgctctctgtaaaaagacgtgctggactactgaatgtttatcccggatacagatgcgaatggtggtgaatgacgagccatgcctcctgtcctacgagtattaatagtgaatggactttttggaattctggaacccattcatctacccccgcaggctg

SEQ ID NO: 188 - DNA, 26 bp, Diabrotica virgifera
ccttaggcatgtaagtgtggctgtcg

SEQ ID NO: 189 - DNA, 23 bp, Diabrotica virgifera
ctcgtaggacaggaggcatggct

SEQ ID NO: 190 - DNA, 717 bp, Diabrotica virgifera
ccttaggcatgtaagtgtggctgtcggagatactcaaagacagcaacatgtacgtatacggtttcgacattacatagacgtgtaatatgcgtgcgagtgcttgatcacggtgaagttctggcgtgaacggtggctcggaggaatcatggcgtcggtggcgggctcgcaagaacagccgcccgccgcgcacggccatagcttctgcaagaagaccttccacaagcccacctactgccaccactgcagcgacatgttatggggcctcatccagcagggcttcatctgcgaagtttgcaacttcgtagtgcatgatcgctgcttaaggactgtggtatccccgtgttccagcgtctccgccagtcaaataagaaatccggttgcacactgttggtcggagtcgtttcaccataaaagaaaattttgcaacgtatgtagaaaacggttagatgacagcgaatccattcattgcgaaatttgtgagtatttcgtacatgtggagtgccaggattttgcagtagctgactgtaaagaaaatgcaacttatcttccgggaaaacaacttaccttcgtgcgtcatcaacatcactggcgcgaaggaaatcttccaagcaattccaagtgtgctctctgtaaaaagacgtgctggactactgaatgtttatccggatacagatgcgaatggtgtggaatgacgagccatgcctcctgtcctacgag

SEQ ID NO: 191 - DNA, 826 bp, Diabrotica virgifera
  modified_base (752): n = a, c, g or t/u
gcagtggttagtgcagttttgtgatttaagaagattacgatggttactaccacgaatgcggtcactagtactagcatgattcaaggaaatagtacgacgcctacatctaacacccctggcacaggcgagaataataatggtgttaagagaattagtgataatagaaggagtaacaagcctattatggagaaaaggcggagggcgaggataaataactgtctcaatgagttgaaaacgctcatattggacgccatgaaaaaagatcctgccagacattcaaagctggaaaaagctgacatcctggagatgacagtcaagcatttacagaaccttcaaagacagcaagtcgctatgtcagcggcagcagatcccttagtagttaataaattcagagcagggtttagcgagtgcgcttcagaagtcggcagatttccaggtctagatccaatcgtccgacgaaggttactccagcatctagccaactgtctcagccaaggttccaaaccacaagaagttcctcaagtacaagttcacatacttccaaacactcaaaaacctttagaacagcaagtaccccaaagcagtggcattattcttagtaacggtaacggtactggagttcaactagtaccaacaagactaccgaatggagatttagctctggtacttcctacgaccttacaaacacagccccagtattcaccggcggcagtaccattattagtgccgatagtaccggaaagaaccgcttncaccacatcagcgaccagcagttactcgaattatttctccagtcatagtccagagcctatggagtctatgtaca

SEQ ID NO: 192 - DNA, 31 bp, Diabrotica virgifera
gcagttttgtgatttaagaagattacgatgg

SEQ ID NO: 193 - DNA, 30 bp, Diabrotica virgifera
gctgtgtttgtaaggtcgtaggaagtacca

SEQ ID NO: 194 - DNA, 679 bp, Diabrotica virgifera
gcagttttgtgatttaagaagattacgatggttactaccacgaatgcggtcactagtactagcatgattcaaggaaatagtacgacgcctacatctaacacccctggcacaggcgagaataataatggtgttaagagaattagtgataatagaaggagtaacaagcctattatggagaaaaggcggagggcgaggataaataactgtctcaatgagttgaaaacgctcatatcggacgccatgaaaaaagatcctgccagacattcaaagctggaaaaagctgacatcctggagatgacagtcaagcatttacagaaccttcaaagacagcaagtcgctatgtcagcggcagcagatcccttagtagttaataacttcagagcagggtttagcgagtgcgcttcagaagtcggcagatttccaggtctagatccaatcgtccgacgaaggttactccagcatctagccaactgtctcagccaaggttccaaaccacaagaagttcctcaagtacaagttcacatacttccaaacactcaaaaacctttagaacagcaagtaccccaaagcagtggcattattcttagtaacggtaacggtactggagttcaactagtaccgacaagactaccgaatggagatttagctctggtacttcctacgaccttacaaacacagc

SEQ ID NO: 195 - DNA, 873 bp, Diabrotica virgifera
  modified_base (709)..(772): n = a, c, g or t/u
cgacgaagtcaccgtgggtaaattctacgcgactttcctcattcaggattacttcaggcggttcaagaagagaaaagagcaggagatgagggacggagataaagatattcagaataccgttacacttcaagctgggttgcgtacgttacatgaggctggtccagaactgaaacgcgccatctcaggcaatctagatgaattaattgatgacaatcccgaaccaatgcatcgtagaaatcattcactcttcggaagtgtatggtcttcaatgagacgaggtcatactttcaatagagcgaaatctctgaagttaaattcaacccaaatcaaaattacaccggcttccagcgtcgactatcttccatacaattctattaagaatgccgtcacagaagggatgaatcacattacttccatgacgaaaaacgttcaaaaccgtgttagcgctagttccttgaacaatcaggataactataaggatgaagaaattcctctgaggtctcttagtaatctgcataatggagatgagaagaataactacacggtcatcgataaatctggcttcctgcaccctaactacaaggttggagcaggtgaggcgaatggtcacgtgggaccagagcgtcttagccattcactgcctggcagtccggccgaccgtagacttgcttccttcgaagtcgtaggctctgcggaaagcctggtaggncgaatcctagccgagcaaggcttaggtaagtactgtgatcaggatttcgtgcgctacacctnncgaagagatgcagaggcattggatatgactcaggaggaaatggatcgcgcagcccaccagattcttttcacagagaaacttatacatcatcctctgcagca

SEQ ID NO: 196 - DNA, 25 bp, Diabrotica virgifera
cgacgaagtcaccgtgggtaaattc

SEQ ID NO: 197 - DNA, 24 bp, Diabrotica virgifera
cgaaggaagcaagtctacggtcgg

SEQ ID NO: 198 - DNA, 677 bp, Diabrotica virgifera
cgacgaagtcaccgtgggtaaattctacgcgactttcctcattcaggattacttcaggcggttcaagaagagaaaagagcaggagatgagggacggagataaagatattcagaataccgttacacttcaagctgggttgcgtacgttacatgatgctggtccagaactgaaacgcgccatctcaggcaatctagatgaattaattgatgacaatcccgaaccaatgcatcgtagaaatcattcactcttcggaagtgtatggtcttcaatgagacgaggtcatactttcaatagagcgaaatctctgaagttaaattcaacccaaatcaaaattacaccggcttccagcgtcgactatcttccatacaattctattaagaatgccgtcacagaagggatgaatcacattacttccatgacgaaaaacgttcaaaaccgtgttagcgctagttccttgaacaatcaggataactataaggatgaagaaattcctctgaggtctcttagtaatctgcataatggagatgagaagaataactacacggtcatcgataaatctggcttcctgcaccctaactacaaggttggagcaggtgaggcgaatggtcacgtgggaccagagcgtcttagccattcactgcctggcagtccggccgaccgtagacttgcttccttcg

SEQ ID NO: 199 - DNA, 418 bp, Diabrotica virgifera
acggaaacacagttacctgtatcgttccgacatttgattttgcccgagaaaaacttccctcctactgaattgctggacttgcaaccgctgcctattactgctttgagaaacgaacaatttgagtctttatacgccgataagtttccacagtttaatcctatacaaacacaggttttcaactcagtatacaatggagacgacaacatattcataggcgctcccacgggatcaggaaagaccacaatagcaaaatttgccatcctcagactcttcgattgaaatcctgaaggtcgatgtgtttatctagttcctaaggacgccctcgctgaactgattttcgccgattggcataataagtttggacaggccttggcaaagaaagtggtattgctgactggagaaactggtactgatctaa

SEQ ID NO: 200 - DNA, 29 bp, Diabrotica virgifera
cacagttacctgtatcgttccgacatttg

SEQ ID NO: 201 - DNA, 31 bp, Diabrotica virgifera
gatcagtaccagtttctccagtcagcaatac

SEQ ID NO: 202 - DNA, 408 bp, Diabrotica virgifera
cacagttacctgtatcgttccgacatttgattttgcccgagaaaaacttccctccgactgaattgctggacttgcaaccgctgcctattactgctttgagaaacgaacaatttgagtctttatacgccgataagtttccacagtttaatcctatacaaacacaggttttcaactcagtatacaatggagacgacaacatattcataggcgctcccacgggatcaggaaagaccacaatagcagaatttgccatcctcagactcttcgatcgaaatcctgaaggtcgatgtgtttatctagttcctaaggacgccctcgctgaactgattttcgccgattggcataataagtttggacaggccttggcaaagaaagtggtattgctgactggagaaactggtactgatc

SEQ ID NO: 203 - DNA, 735 bp, Diabrotica virgifera
cactgtcattcgtcattctcatacattttttttgggtactttgggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtaccatctttctctggtagctttggtatccttcccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgctgttgaagtgggagaagcgttagtcaaagcggctgaataataatttaatttttgtaattttatgtaaatttaataaattagtgtctcaatggtactgttcattttaaaacaacaacatattagatctatacctctatgagttgacaatttttacaaaaacgagaatcaatccaaatacataatttttgt

SEQ ID NO: 204 - DNA, 31 bp, Diabrotica virgifera
ggtactttgggttgtacttgggataaaagac

SEQ ID NO: 205 - DNA, 27 bp, Diabrotica virgifera
gctttgactaacgcttctcccacttca

SEQ ID NO: 206 - DNA, 542 bp, Diabrotica virgifera
ggtactttgggttgtacttgggataaaagacctttttgtatttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgttagtcaaagc

SEQ ID NO: 207 - DNA, 686 bp, Diabrotica virgifera
tatatttaataattaatacagatttttaagtatggcaccaaaggaaaaagatgatgaaatcgtatcaataaataaatgggatggagtagccgtcaaaaatgcattagatgatgcagttaaagaggtacttacaaagaaatacaattatgctgaaaattttgctctcatggatggtaggttagttatatgtggcatagctgtaggtgttgcaatgtttgccttgatttgggattatttgtacccattcccacaatctaagcctattttaatattttctgttactacatatttttttatgatgggaattttaactttatatactacatacaaagagaaaggaatctttgctgtttgtattcagaaagatagttctaagaaggaaaatacttgggaagctagctcttatattcaaaagtatgatgataagtatactttgaatcttgcatatattgatggaaaaacacgccaaagaagagagcagagtattaaaaggagtattgccaggtacatagaccagcaaggaactgtagttaaagaaaatgttgaagatgaaatcaccaaaatgcacaattctctactaagtgagaggaaagaaaaatgatgtacacagagactacctactaaaagaagttgacgtgtaaattatttcattttttatatttttcaataagtttttttggtttgag

SEQ ID NO: 208 - DNA, 28 bp, Diabrotica virgifera
gtatggcaccaaaggaaaaagatgatga

SEQ ID NO: 209 - DNA, 30 bp, Diabrotica virgifera
cattttggtgatttcatcttcaacattttc

SEQ ID NO: 210 - DNA, 536 bp, Diabrotica virgifera
gtatggcaccaaaggaaaaagatgatgaaatcgtatcaataaataaatgggatggagtggccgtcaaaaatgcattagatgatgcagttaaagaggtacttacaaagaaatacaattatgctgaaaattttgctctcatggatggtaggttagttatatgtggcatagctgtaggtgttgcaatgtttgccttgatttgggattatttgtacccattcccacaatctaagcctattttaatattttctgttactacatatttttttatgatgggaattttaactttatatactacatacaaagagaaaggaatctttgctgtttgtattcagaaagatagttctaagaaggaaaatacttgggaagctagctcttatattcaaaagtatgatgataagtatactttgaatcttgcatatattgatggaaaaacacgccaaagaagagagcagagtattaaaaggagtattgccaggtacatagaccagcaaggaactgtagttaaagaaaatgttgaagatgaaatcaccaaaatg

SEQ ID NO: 211 - DNA, 901 bp, Diabrotica virgifera
  modified_base (707): n = a, c, g or t/u
cggacgcgtgggctaatagcattgtgttatccatttttagcttctagtgtcaatgagtacattccattgattattaaaaatctagatgaacatactgatggggtctgtaataatgctgcttgggtgattggaaagttgtgtgctgtgatgggcaatgcaatccaacctttccttccagaaatccttaatgcctttgttcatatattaagaacaccagctgtagctcgtaccatgcacaaaactgtagctatttccttatgcatcgtattctatgtgtgccccgatgtgactattccagaaatggatgtgattgttaagaattgctgtatgttagtgagaaatgttagggattcagatgagaaggatcttgcttttcgaggcttgtgtgaggtgattataaggcatccagaattcaacaagaactacttcatcttcttttgtgatgctgcagcttcctggatcaatatccgtgtagatttgaagcagacaattcgcaatgttctattggcatttaaacaacaatgtggtgaggataactggcgccaattttattgtcagtttcctgaagctcttaaacttaaacttcaagagttatatggggtatgaaataaacaatctacaaaaaacggggaattcgacatatgggtgggaaagcttgagtgcacctgccttgagtttatcgcgtaatagtatttaaatatcgtccngtgagggaggggcgtcttgccggtatcttagagtcacgcgttaataaaaaaatcgagaaggatttttttagacagattaatttttttgttttatgggtagtttcttagtaaatcaactaaataatgtttatttaattattttttaaggaattttataacaaatatggtaatttatattgtggaagtgtttttat

SEQ ID NO: 212 - DNA, 27 bp, Diabrotica virgifera
cgtgggctaatagcattgtgttatcca

SEQ ID NO: 213 - DNA, 28 bp, Diabrotica virgifera
gaacattgcgaattgtctgcttcaaatc

SEQ ID NO: 214 - DNA, 496 bp, Diabrotica virgifera
cgtgggctaatagcattgtgttatccatttttagcttctagtgtcaatgagtacattccattgattattaaaaatctagatgaacatactgatggggtctgtaataatgctgcttgggtgattggaaagttgtgtgctgtgatgggcaatgcaatccaacctttccttccagaaatccttaatgcctttgttcatatattaagaacaccagctgtagctcgtaccatgcacaaaactgtagctatttccttatgcatcgtattctatgtgtgccccgatgtgactattccagaaatggatgtgattgttaagaattgctgtatgttagtgagaaatgttagggattcagatgagaaggatcttgcttttcgaggcttgtgtgaggtgattataaggcatccagaattcaacaagaactacttcatcttcttttgtgatgctgcagcttcctggatcaatatccgtgtagatttgaagcagacaattcgcaatgttc

SEQ ID NO: 215 - DNA, 916 bp, Diabrotica virgifera
  modified_base (870): n = a, c, g or t/u
ctgtcgggatgtaagagctatgattgaaaggcaggcgtctagacattgcgatcggcaggcagaatagcaggaaagcaagacaaatcctaaagatcaagcgtcatcgggtttagaccggcatacagcatgcgaccgcatgggcataaggagatcgcagtgatcgcacccgtatcggctaatagacacagacacagacacggtgtgttcggtatttttagttagtctgttcgcgaccggcgaagaagtagcgcgtgtgtttaaatagagagttatggtgataacgtcaacgtgtgttgtgacggtgtttaagatcaacggtcggcaccggagtcgacaacgccagtgagcaagcagtgcgacactatgtcccagtcatggtgaaaacgtttctgggactgttagctgcttcaatttgtggtctcgtatacgctgctccattagctgactcttgcaataatctgaccccttttcgaacagatagcacaacccctacttcttcagaagagtcattgctagaggatccagcagcacgcaacgaaagaagcacaaatctctctcacgtcactggtaccgccagaaaaatacaaatgttcatcaagaatcgacatttacaaattcttcctgacgggacagtcaacggaaccactgacgacactagtgcttattcgatattacaaaggacgacggtgggaattggtcaaatgaaaattcaaggtgtggttacctgtcagtatttgtgcatggccaggtgtggattgctctatggatcgagagaatttggacaagaatgcgtattcaatgagaccatcgagcaatccaactacaacacgtattcctcccagtaatactcaaacgagaaaagaacccttnatctagcactgaatcaaagaggccaatcgagaaaggtcgtcctacg

SEQ ID NO: 216 - DNA, 26 bp, Diabrotica virgifera
gctatgattgaaaggcaggcgtctag

SEQ ID NO: 217 - DNA, 27 bp, Diabrotica virgifera
ggtctcattgaatacgcattcttgtcc

SEQ ID NO: 218 - DNA, 789 bp, Diabrotica virgifera
gctatgattgaaaggcaggcgtctagacattgcgatcggcaggcagaatagcaggaaagcaagacaaatcctaaagatcaagcgtcatcgggtttagaccggcatacagcatgcgaccgcatgggcataaggagatcgcagtgatcgcacccgtatcggctaatagacacagacacagacacggtgtgttcggtatttttagttagtctgttcgcgaccggcgaagaagtagcgcgtgtgtttaaatagagagttatggtaataacgtcaacgtgtgttgtgacggtgtttaagatcaacggtcggcaccggagtcgacaacgccagtgagcaagcagtgcgacactatgtcccagtcatggtgaaaacgtttctgggactgttagctgcttcaatttgtggtctcgtatacgctgctccatagctgactcttgcaataatctgaccccttttcgaacagatagcacaacccctacttcttcagaagagtcattgctagaggatccagcagcacgcaacgaaagaagcacaaatctctctcacgtcactggtaccgccagaaaaatacaaatgttcatcaagaatcgacatttacaaattcttcctgacgggacagtcaacggaaccactgacgacactagtgcttattcgatattacaaaggacgacggtgggaattggtcaaatgaaaattcaaggtgtggttacctgtcagtatttgtgcatggccaggtgtggattgctctatggatcgagagaatttggacaagaatgcgtattcaatgagacc

SEQ ID NO: 219 - DNA, 2176 bp, Diabrotica virgifera
caaaattatttaagtagtggagtccaaatagactatttcttcttttgggctttttctgcagcttttgtgacttttccagtagtatcttcatcttcagtgaatacaccaatacgtctgcaaatggcttcagcagtagctttgttgtcaccagtgataacaataactctgataccagcagcgcggcattgaacaatggagtcaaatacttctttacgtgggggatccaacataccaacaacaccaacgaatgtaagattgacttcatatgtgtagaatttggttgaatcgccaaggtccatttcgtctggtttcatggggttatcagcagttgctagggcaagacaacgcaatgtgtcgcgtccacaaccatattgagcggtaagatcagtgattctctttttaagagtgctggtaagtggtactttttgagatccaacacgagcgtgtgtacacctttccaaaacaccttctggagctcctttaacgaagagtttaggtccattaccaatacgagatggtttgaggggtgtgcagtaggaagacatagatttacgatcacgtgagaattccaaagtgaattccttcttccatttagtttcaatgtcttgtctaacacagatggcaacctgtctacgatctccagttttactgacagagaagggattcattttttctgctaatacaatgagagcagtttcagtagcttcaccaactttttcgaaagcttgtttgaattcattgaaatcaatggcggagtcattgcacataatacaaatggtaccaatttcatgtaatgcgtcaaattctgcacatttaactttttgtcctttaaggaatacttcaccaataggttcataagtggagccagtgatttcaaattcatggaaagagctgtcgctgccttcaactttatcgaaaataaacatacgtgagactgacatttggttggtggttaaggtaccagttttatcggagcagatgacagatgtgcaaccaagagtttctacagatggaagggaccttacaatagcgtttttcttagccatacgacgagtaccaagagcaagacatgtagtaatgacagctggtagaccttcaggaatggcagcgacagccaaagctacagcgattttgaagtagtagacagcacctttaatccatgaaccaccatgggctgggtcattgaaatgtccaatgttaatagcccatacagcaacacagatgactgaaatgactttggagagttgttcaccgaattcgtccaatttttgttgaaggggagtcttaatttcttccgtttctgacatttcagttctgattttaccaatggcggtgttaagaccagttccaataacaataccacgtgctttaccagcagcaacattggtacctgagaaaagaatgtttttcttgtcttggttgacagctcttgggtcgggaatggcatcggtgtgtttgatcacagaaacggattcaccagtcaggatagactgatcgatacggagtgttgttgagaaaattttaactaaacgaatatcagcgggaattttgtcacccactgacacttctactatatctccgggtacgatttctttcgcccggattttctgaataccggatttgtcttgtcggacaactttgcccatttctggttcatattctttaagagcttcaatggcggattcagcatttctttcctgccatacacctactactgcgtttgcaataagaattaaaagaattacaaaaggttctacgaacgcggtgaatgcgccatcgtgttcttcaaataaagctaatacaaaggaaattatagcggctaataataaaatcttgactagaagatcatcaaactgttctaaaactaattgccatatggattttccttcttccgcaggaagttcattgggtccatatttagcttgattctttttgacttgatcaagtgaaagacctcgttcttgatcagcgtcgaagtacctaagtacttcgtccactgtttttgcgtgaccatcctccattctgcccagttgtcacttcgcttgttatcacaaaaatggtcccagtagttatcacttgacgaaaactttggtggattatcaaaggttaacaacgacacggtattgtttaggcccccatttaagagtagcacaaaattgtcacagaagtttagagc

SEQ ID NO: 220 - DNA, 33 bp, Diabrotica virgifera
gctctaaacttctgtgacaattttgtgctactc

SEQ ID NO: 221 - DNA, 30 bp, Diabrotica virgifera
gaaatgtccaatgttaatagcccatacagc

SEQ ID NO: 222 - DNA, 992 bp, Diabrotica virgifera
gctctaaacttctgtgacaattttgtgctactcttaaatgggggcctaaacaataccgtgtcgttgttaacctttgataatccaccaaagttttcgtcaagtgataactactgggaccatttttgtgataacaagcgaagtgacaactgggcagaatggaggatggtcacgcaaaaacagtggacgaagtacttaggtacttcgacgctgatcaagaacgaggtctttcacttgatcaagtcaaaaagaatcaagctaaatatggacccaatgaacttcctgcggaagaaggaaaatccatatggcaattagttttagaacagtttgatgatcttctagtcaagattttattattagccgctataatttcctttgtattagctttatttgaagaacacgatggcgcattcaccgcgttcgtagaaccttttgtaattcttttaattcttattgcaaacgcagtagtaggtgtatggcaggaaagaaatgctgaatccgccattgaagctcttaaagaatatgaaccagaaatgggcaaagttgtccgacaagacaaatccggtattcagaaaatccgggcgaaagaaatcgtacccggagatatagtagaagtgtcagtgggtgacaaaattcccgctgatattcgtttagttaaaattttctcaacaacactccgtatcgatcagtctatcctgactggtgaatccgtttctgtgatcaaacacaccgatgccattcccgacccaagagctgtcaaccaagacaagaaaaacattcttttctcaggtaccaatgttgctgctggtaaagcacgtggtattgttattggaactggtcttaacaccgccattggtaaaatcagaactgaaatgtcaggaacggaagaaattaagactccccttcaacaaaaattggacgaattcggtgaacaactctccaaagtcatttcagtcatctgtgttgctgtatgggctattaacattggacatttc

SEQ ID NO: 223 - DNA, 2176 bp, Diabrotica virgifera; identical to SEQ ID NO: 219

SEQ ID NO: 224 - DNA, 29 bp, Diabrotica virgifera
gtggttcatggattaaaggtgctgtctac

SEQ ID NO: 225 - DNA, 32 bp, Diabrotica virgifera
caccagtgataacaataactctgataccagca

SEQ ID NO: 226 - DNA, 1023 bp, Diabrotica virgifera
gtggttcatggattaaaggtgctgtctactacttcaaaatcgctgtagctttggctgtcgctgccattcctgaaggtctaccagctgtcattactacatgtcttgctcttggtactcgtcgtatggctaagaaaaacgctattgtaaggtcccttccatctgtagaaactcttggttgcacatctgtcatctgctccgataaaactggtactttaaccaccaaccaaatgtcagtctcacgtatgtttattttcgataaagttgaaggcagcgacagctctttccatgaatttgaaatcactggctccacttatgaacctattggtgaagtattccttaaaggacaaaaagttaaatgtgcagaatttgacgcattacatgaaattggtaccatttgtattatgtgcaatgactccgccattgatttcaatgaattcaaacaagctttcgaaaaagttggtgaagctactgaaactgctctcattgtattagcagaaaaaatgaatcccttctctgtcagtaaaactggagatcgtagacagattgccatctgtgttagacaagacattgaaactaaatggaagaaggaattcactttggaattctcacgtgatcgtaaatctatgtcttcctactgcacacccctcaaaccatctcgtattggtaatggacctaaactcttcgttaaaggagctccagaaggtgttttggaaaggtgtacacacgctcgtgttggatctcaaaaagtaccacttaccagcactcttaaaaagagaatcaccgatcttaccgctcaatatggttgtggacgcgacacattgcgttgtcttgccctagcaactgctgataaccccatgaaaccagacgaaatggaccttggcgattcaaccaaattctacacatatgaagtcaatcttacattcgttggtgttgttggtatgttggatcccccacgtaaagaagtatttgactccattgttcaatgccgcgctgctggtatcagagttattgttatcactggtg

SEQ ID NO: 227 - DNA, 1929 bp, Diabrotica virgifera
cacttaattttcagtactggggcgactggcaaaaaaatgtctttgctttccgcacgattagctgcctcattggcaagaaatgcccctaaaaatgtaacacagattgcgggagctgtcttccctgctgcatccgtcgcagcccggaacttccatgctactccacaaaacaaaggtgctgaaatttcatccatccttgaagagcgcatccttggtgctgcaccaaaagccaacctcgatgaaacaggacgagtcttaagtattggtgacggtatcgcccgtgtatatgggttgaacaacatccaagccgatgagatggtggaattctcctccggtctcaaaggtatggcccttaacttggaacctgacaacgttggtgttgtagtatttggtaacgacaaactcattaaggaaggtgacattgtcaagagaactggtgccattgtagatgtgcctgtaggtgaccaaattttgggacgtgtagttgatgccttaggtaacccaattgatggcaaaggaccattgaacaccaaacaacgtttccgtgtaggtatcaaagcccctggtatcattccacgtatctctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagacgaaaagaagaaattgtactgcatttacgtcgccatcggtcaaaagagatctactgtggctcaaatcttgaagcgtctcacagacactggtgccatcaactacacaatcattgtatcagctactgcatctgatgctgcacctttgcaatacctcgccccatactccggatgtgctatgggtgaatttttcagagataatggcaaacatgccctcatcatctatgatgatttgtccaaacaagccgtagcctaccgtcagatgtctctgttgcttcgtcgtcctccagggcgtgaagcctaccctggtgatgtattctaccttcactcccgtcttttggaacgtgccgccaagatgtctgaagcccacggtggtggttcattgactgccttgcccgtaattgaaacccaagctggtgatgtatcagcctacattccaaccaatgtcatttccatcactgatggacaaatcttcttggaaactgaattgttctacaaaggtatcagacctgccattaacgtaggtttgtctgtatccagagtaggatcagctgctcaaaccaaggccatgaaacaggttgctggttccatgaaactggaattggcccaataccgtgaagtagctgcttttgcccaattcggttccgatcttgatgctgctactcagcaattgttgaacagaggtgtacgtcttactgaattgttgaaacaaggtcaatacgtacccatggctattgaagaacaagtagccatcatctactgtggtgtcagaggacatttggacaaagttgatccatcaaagattacagtatttgaaaaacaattctcagaacacattaagactagccacaaaaacatcttgcagagcattgccaaggaaggaaaaatcacagacgatactgatgcccaactcaagaaagtcgttcaagatttcttggccagcttctctggttaaatataaataatacaattattattaatacctaaatcgtcacttttgttgatgtgatctgtaaacgtttaagaacttcatgagctgtaatcctttcaaattagaataattaggcaggactcctatgttatccaataaggcacgtgaaagaattttcttttctccattttacaatatttatcgatcattgttttttaaggatatcttatttgtaataataaaaaataaactttatatttt

SEQ ID NO: 228 - DNA, 24 bp, Diabrotica virgifera
gtctttgctttccgcacgattagc

SEQ ID NO: 229 - DNA, 26 bp, Diabrotica virgifera
gttgatggcaccagtgtctgtgagac

SEQ ID NO: 230 - DNA, 799 bp, Diabrotica virgifera
gtctttgcttccgcacgattagctgcctcattggcaagaaatgcccctaaaaatgtaacacagattgcgggagctgtcttccctgctgcatccgtcgcagcccggaacttccatgctactccacaaaacaaaggtgctgaaatttcatccatccttgaagagcgcatccttggtgctgcaccaaaagccaacctcgatgaaacaggacgagtcttaagtattggtgacggtatcgcccgtgtatatgggttgaacaacatccaagccgatgagatggtggaattctcctccggtctcaaaggtatggcccttaacttggaacctgacaacgttggtgttgtagtatttggtaacgacaaactcattaaggaaggtgacattgtcaagagaactggtgccattgtagatgtgcctgtaggtgaccaaattttgggacgtgtagttgatgccttaggtaacccaattgatggcaaaggaccattgaacaccaaacaacgtttccgtgtaggtatcaaagcccctggtatcattccacgtatctctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagacgaaaagaagaaattgtactgcatttacgtcgccatcggtcaaagagatctactgtggctcaaatcttggagcgtctcacagacactggtgccatcac

SEQ ID NO: 231 - DNA, 1519 bp, Diabrotica virgifera
aatttatatcacaagacttccagttgggagttgggtcagagttaattttttaggtcttctattaaaagggttgtaattttaatttaaaaaaatggcatccaatttagttgcgggagcaaatcctaaaatacaggatataatgtcgtctttggacgatgacaaaacagatatgttggctgctacaagtgtattgcagcaaagagctacagatataagaaatcaacatgtaaactggcaatcctatttccagtcacaaatgatttcgcaggaagactacaacttcatagtagcttttgatgtgactgatagtgcaaaaagagaagctctcctgaaaagcgacagaaaccaatgtgctcaaacattgttgaaccttttggggcatgtatccaaggaccaaactctgcagtacattttagttttggttgatgatatgttacaggagaacagaagtcgtgtagagatatttcacgaatatgccaaccaaaagaaagaatctgtttggggtccatttttgaaccttcttaaccgccaggatggatttattaccaacatgacttctaggatcatcgctaaaattgcttgttggtcgcagacacttatggatcgttctgaccttcatttttacttgacctggttaaaagaccaactaaaaactcagaacaacgaatacatccaatcggttgcaagatgccttcaaatgatgctccgaattgacgactaccgttttgccttcgtgtccgtcgatggaatatccactctgttgtcggtactctctggaagagtaaatttccaagttcagtatcagctgatattctgcttgtgggtactcactttcaacccgttgttagccgaaaagatgaacaaattcaacgttattcctatattggcagatattttgagcgattcggtaaaggagaaagtaaccagaattattttagctgttttcaggaatttgatcgaaaaacccgaagatcaacaagtttcaaaagaacattgtatagctatggtgcaatgcaaagtattgaaacaattggccattttagaacagcgcaagttcgatgatgaagatgtgacagctgatgtcgaatttctaactgaaaaactacagagttctgttcaggatctgagttccttcgatgaatattcaactgaagtcaaatctggacgtttggaatggtctccagtacacaagagcaagttctggcgggaaaatgcgcagcgcctcaacgagaaaaactacgaattactccgtattctcattcatttgttagaaaccagcaaggaccccttggtattgagcgtagctagtttcgatattggagagtatgttcgccattatcctcgcggcaaacacataatcgagcagttgggaggaaagcaattagttatgcaactcttagcccacgaagatcccaatgtacgatatgaagctctgttggcagtccaaaaattgatggtccacaattgggaataccttggtcgtcaacttgaaaaagagcaaagtacagataaaaacgcg

SEQ ID NO: 232 - DNA, 31 bp, Diabrotica virgifera; identical to SEQ ID NO: 72

SEQ ID NO: 233 - DNA, 21 bp, Diabrotica virgifera
gcacctccaccaccgctcttc

SEQ ID NO: 234 - DNA, 490 bp, Diabrotica virgifera; identical to SEQ ID NO: 74

SEQ ID NO: 235 - DNA, 1850 bp, Diabrotica virgifera
gtgaactgaactgtgccggtgtgatttcccttttaaataaaagaaaagttcaaaatcgtgatcgaaaaaaccttttattatattaatacaattttttaaaatggctgcaatgtctgtgataggtatcgatttgggaaatgaatcctgttatgtagctgtcgcaaaggctggtggaatcgaaaccattgcaaatgactacagtttaagggctactccatcatgcgttgctttttctggaaagaaccgcatattgggagttgcggcgaaaaatcagcaagtcaccaatatgaagaacactgtatatgggctaaaaaggctgttaggtagaaagtttagggatcctcatgtcaaaaaagaaattcagtttttaccatatacagttgtagaagaaaaaaacgggggtattggaattagggtaaattatttaaatgaagaacataaattttcaccagaacaatgtttggccatgttgttaacaaaattaaaagatagtgctatgacagctctacaaactcccataaatgattgtgttatatcagttccttcttactttacaaacaatgagaggaaggcactattagattctgcagccatagcaggtcttaatactctaaggttatttaatgaaacaacagctacggccttgtcatatggcatttacaagcaggatttaccagctgtcgaagaaaagcctcgtaatattatttttgtcgattgtggccattcatccttacaagtatttgcagttgcatttaataagggcaaattgaagatgcttaccactgctgcagatcccaatttaggtggtagggactttgatctcatcattgctgagcatttttgcaaacaattccaaaccaaatacaacatggatgcaaaatctaatccaagagcttttctaagattgctaacggaggtagaaaagttgaagaagcagatgtctgcaaattctacaaccttaccactcaacatagaatgtttcatgaacgataaagatgtgtccagtgacatgaagagagcagatatggaaactttatgtgctcatctgtttgaaagagttgaagtaagcttaaagcaatgtctcaaacaatcaggattgtcattggatgacatttacgctgtagaaatagtgggcggatctagcagagtacctgctattaaacaattaatagagaaagtattccacaaagtaccaagtactacattaaatcaagatgaagctgtgagccgtggttgtgctctacagtgtgctatgctatctcctgctataagagttcgggattttagcgttacagatgtacaggcgtacccgatctctgtagcatgggatgcaagtccaggaggagaatctgctggggagatagaagcattcccacttaaccatccggttccattctcgagaatgttgacattctatagacaggaaccattcaccatcagagcaaaatacagtggcaacatcccgtatcccgatcatgatataggtacctgggttataaaagacataaaacctaactctgaaggaaagccgcagaaagtgaaagtcaaggtccgtgtaaacctccatggaatcatgtcgatatcgagtgctagtttgtacgaagcaaaagagtcagttgaaccagaaagtccggaagaacaacagaaggaggcacaggtgaacagtaacgaccaacagaatggcggtgtgcagactaacgagagcggcgaatcgatggaaacgacaaacgaaggaacaggagccaacagtggagaaggtgctgttcctgaggtaggctccggcaccagctggacgaagaaaatatctgcctggttcagcggggaaggaagcgataaaaagaaaaaagcat

SEQ ID NO: 236 - DNA, 23 bp, Diabrotica virgifera
ctgtcgcaaaggctggtggaatc

SEQ ID NO: 237 - DNA, 31 bp, Diabrotica virgifera
ctcttcatgtcactggacacatctttatcgt

SEQ ID NO: 238 - DNA, 862 bp, Diabrotica virgifera
ctgtcgcaaaggctggtggaatcgaaaccattgcaaatgactacagtttaagggctactccatcatgcgttgctttttctggaaagaaccgcatattgggagttgcggcgaaaaatcagcaagtcaccaatatgaagaacactgtatatgggctaaaaaggctgttaggtagaaagtttagggatcctcatgtcaaaaaagaaattcagtttttaccatatacagttgtagaagaaaaaaacgggggtattggaattagggtaaattatttaaatgaagaacataaattttcaccagaacaatgtttggccatgttgttaacaaaattaaaagatagtgctatgacagctctacaaactcccataaatgattgtgttatatcagttccttcttactttacaaacaatgagaggaaggcactattagattctgcagccatagcaggtcttaatactctaaggttatttaatgaaacaacagctacggccttgtcatatggcatttacaagcaggatttaccagctgttgaagaaaagcctcgtaatattatttttgtcgattgtggccattcatccttacaagtatttgcagttgcatttaataagggcaaattgaagatgcttaccactgctgcagatcccaatttaggtggtagggactttgatctcatcattgctgagcatttttgcaaacaattccaaaccaaatacaacatggatgcaaaatctaatccaagagcttttctaagattgctaacggaggtagaaaagttgaagaagcagatgtctgcaaattctacaaccttaccactcaacatagaatgtttcatgaacgataaagatgtgtccagtgacatgaagag

SEQ ID NO: 239 - DNA, 1188 bp, Diabrotica virgifera
tagaatttcagacttttgacaaattaaaattttgaacaatttattttattaatttcaatcacattgcagttttaaaaagaattaaaaatggtatccctaaatcccgtaagaattctcaagcaagaagccgaggaagaaagggcagagattgcccgactcagtagttttgtaggtgctatagctataggagatttggttagaagcaccttgggaccaaaaggaatggataaaattttagtatccagtggtagatctgcaggatcagttgaagttactaacgacggagcaactatcctaaaatcggtgggtgttgataatcctgctgctaaaattttggtggatatgtcaaaagtccaggatgatgaagtaggagatggcaccacatcagtgacagtattagcatctgaactacttaaagaagcagaaaaacttgtagaacagaaaattcacccacaaacaatcattgccggttggaggaaagcagtagatattgccagaaaagctcttctagaaactgccaaagacaacagctctgattcagaaaagttcagagaagatctgatgaacattgccagaactacactcagctcaaagattctttcacaacataaagaatattttgccaaactggcagtagatgctgtgctgagattgaaaggtacaggtgatttacaatccatccagctgattaagaaaactggtggtactttggaagattcctttttggatgaaggttttttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttggg

SEQ ID NO: 240 - DNA, 25 bp, Diabrotica virgifera
ggtgggtgttgataatcctgctgct

SEQ ID NO: 241 - DNA, 25 bp, Diabrotica virgifera
caagagcaacaccactgaaacggag

SEQ ID NO: 242 - DNA, 884 bp, Diabrotica virgifera
ggtgggtgttgataatcctgctgctaaaattttggtggatatgtcaaaagtccaggatgatgaagtaggagatggcaccacatcagtgacagtattagcatctgaactacttaaagaagcagaaaaacctgtagaacagaaaattcacccacaaacaatcattgccggttggaggaaagcagtagatattgccagaaaagctcttctagaaactgccaaagacaacagctctgattcagaaaagttcagagaagatctgatgaacattgccagaactacactcagctcaaagattctttcacaacataaagaatattttgccaaactggcagtagatgctgtgctgagattgaaaggtacaggtgatttacaatccatccagctgattaagaaaactggtggtactttggaagattcctttttggatgaaggttttttattggacaaaaaacctggtgtacatcaaccaaagagagtagaaaatgcaaaaatcctgatagccaacactcctatggacacagataaaatcaaagtatttggttctcacattaaggtagattcaatggctaaaattgcagagctggaatctgcagaaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttg

SEQ ID NO: 243 - DNA, 1188 bp, Diabrotica virgifera; identical to SEQ ID NO: 239

SEQ ID NO: 244 - DNA, 32 bp, Diabrotica virgifera
ctcactctgatggtgtaatcactatggaaatc

SEQ ID NO: 245 - DNA, 31 bp, Diabrotica virgifera
gtcttctacaaatgctgatttcaaatggtct

SEQ ID NO: 246 - DNA, 820 bp, Diabrotica virgifera
ctcactctgatggtgtaatcactatggaaatcgtgggatgcagaccttccgattctggaaaatactcctgcgttgctacaaacgaacacggcgtagacgaaacatcttgtgtagttattgtagaaggacaaaccagcacaccagaacaacaagaactagccaacaaattactctattcaggagacaggaagtacattgaacatcctataaagccagctccaattcctgtaactgtgcgaaaaccaataccctcatcaaatcctcaccctctacaaccgaaatctaacaatcctagcacaaatagtttagcgcattcttcatccacactcagtgttggagatggagacaagaggacgcctaggaaatatggtagattagattctactggaagtccaaatagatcaagaagcgcaactaaagaattagcactgcctgatgactcaacaatgtacgccccacaatttaccaaaaatctcacagacttaaccatcaatgatggtgaaagtctaaccttgactgcacacgtaaagggagatccagatcctcaaattgtttggaccaaaaatggaaaagccttgagttcctctgaagttgttgacctcaaatacaagaacggaatagcgaaattacacataaatgaagtataccctgaagatgaaggagaatatgtgtgcagagcaaccaactctgtaggaacctctgagaccaaatgcaaactaaccattaaaccaatggccaatgccaccaacggcaagaaaaaatcctcagaagacaaacccccaagaatagtagaccattgaaatcagcatttgtagaagac

SEQ ID NO: 247 - DNA, 815 bp, Diabrotica virgifera
gttataccagaaaaagaagaaggtagtccttcggaagtaaaacaagtgctgcaggatgtggatactgaagatttgtacactaaatataaaaaacttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaaaaccttctgctagtgttgctcttcataaacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggtgagagacgtgttccgtctagcaaaagaaaattctccagcaatcatctttattgatgaaattgatgcaatcgctaccaaacgttttgatgcccagacaggtgctgatcgtgaagtccagag

SEQ ID NO: 248 - DNA, 28 bp, Diabrotica virgifera
cttcaacaacagttggagttcttggagg

SEQ ID NO: 249 - DNA, 25 bp, Diabrotica virgifera
ctctggacttcacgatcagcacctg

SEQ ID NO: 250 - DNA, 722 bp, Diabrotica virgifera
cttcaacaacagttggagttcttggaggttcaagaagagtacattaaagatgagcaaaggaatctcaaaaaggagtatttacatgctcaggaagaagtgaagcgtatccagtctgtcccgcttgttattggacagtttttagaagctgtagatcaaaacactggcattgttggctcaactacaggttcaaattattatgttagaatcttatcaacaattgatagagaactcttaaaaccttctgctagtgttgctcttcataaacacagcaatgccttagtagatgtcctaccaccagaggcagattcttcaataagcatgctccaggctgatgaaaaaccagatgttcaatacagtgacattggaggtatggatatgcagaaacaagaaattagggaagctgtagagttacctttgactcacttcgaattgtataaacagattggtattgatccccccagaggtgtgttgatgtatggacctcctggatgcgggaagactatgttggccaaagctgttgctcatcatactacagctgcctttattcgtgtagtcggatcagaattcgtacagaaatatcttggtgaaggtcctcgaatggttagagacgtgttccgtctagcaaaagaaaattctccagcaatcatctttattgatgaaattgatgcaatcgctaccaaacgttttgatgcccagacaggtgctgatcgtgaagtccagag

SEQ ID NO: 251 - DNA, 1324 bp, Diabrotica virgifera
tttaaaattaaaatataaatagaagagaattgtgtttgtataattgtttaaaattaaaataatttaataatggaaaacgaaggcgaagctgtaacagaacagaagcgtctgttgtgttgttttaaatcggaaaatggagaagtcgccggtgatatgatggatctccccatagactgttccttacagcagctcacgttaatttgtaatgctttgttaaaacaggaagaaccagtaccatacttattttacgttaacgaaaacgaaataacccatactttggaaaaagcactaaatataagggaattaaatacagaaggtgttgtagatatcatttatcaacaacaagcagtgtttagggtacgccctgtaacaaggtgtaccagctcaataccaggtcatgcagaagcagttatttcagttagttttagtccagacggtaaacatttagcaagtggatctggtgatacaacagtcaggttttgggatgttgatacgcaatctccgttatatacttgtgaaggtcataaaaattgggtgttgtgtatagcttggtcctctgatagtactaaattggcttctgcttgtaaagatgggaaaattatcatatgggatccttttacaggaaagcaaataggtaaaacgttaacgggacataaacagtggattactagtttaagctcgggagccttatcataaaaaccctgaatgtagatatttggcaagttcttcaaaagatggagatgtaaggatatgggatactgtactcagcaatacatttttttgtatatctggtcatacaaagagtgtaacaatggtgaaatggggtggagcaggtctcatctattcagcctcccaagacagaacagttaaagtatggagagctaaagatggtgtactatgtaggacattagaaggacatgcccattgggttaatacattagctttaaatactgactacattttaaggataggagcatttgatcccgttaaagattcaaataaagacacattaatgccagacaagaaaaaatctcaggactttgccctcaaacgatactatgaagttacagaatctattggagaaagattagtatcgggttctgatgatttcacattatttctttggaatcctgataaagacaagaagcctttagctaggctaacaggtcaccaacaattagtcaatgacgtgaaattttcacctgatggtagaatattagcttcagcatctttcgataaatcaatcaaattgtgggaggcaaaacaggaaagtttatttgtaccctacgtggacatgttcaggctgtgtacatggtatcatttt

SEQ ID NO: 252 - DNA, 28 bp, Diabrotica virgifera
gaaaacgaaggcgaagctgtaacagaac

SEQ ID NO: 253 - DNA, 28 bp, Diabrotica virgifera
gctccaccccatttcaccattgttacac

SEQ ID NO: 254 - DNA, 757 bp, Diabrotica virgifera
gaaaacgaaggcgaagctgaacagaacagaagcgtctgttgtgttgttttaaatcggaaaatggagaagtcgccggtgatatgatggatctccccatagactgttccttacagcagctcacgttaatttgtaatgctttgttaaaacaggaagaaccagtaccatacttattttacgttaacgaaaacgaaataacccatactttggaaaaagcactaaatataagggaattaaatacagaaggtgttgtagatatcatttatcaacaacaagcagtgtttagggtacgccctgtaacaaggtgtaccagctcaataccaggtcatgcagaagcagttatttcagttagttttagtccagacggtaaacatttagcaagtggatctggtgatacaacagtcaggttttgggatgttgatacgcaatctccgttatatacttgtgaaggtcataaaaattgggtgttgtgtatagcttggtcccctgatagtactaaattggcttctgcttgtaaagatgggaaaattatcatatgggatccttttacaggaaagcaaataggtaaaacgttaacgggacataaacagtggattactagtttaagctgggagccttatcataaaaaccctgaatgtagatatttggcaagttcttcaaaggatggagatgtaaggatatgggatactgtcctcagcaacacatttttttgtatatctggtcatacaaagagtgtaacaatggtgaaatggggtggagc

SEQ ID NO: 255 - DNA, 794 bp, Diabrotica virgifera
caaattatcaacaaaacagacgccattttgctaaaattgaaatatccaacaaagtagaaagagattttaaataaatctaaaacatccaaacttttttttgggaacgtatcggaagtaatgtgtctgtgataaatagtaaaaaatattaaagcgatattttcgtcgaaactgatatgtattaaatttatcttttgtgttattaaagagagttaaacgtagctaaagaagaaaaactattagtgatttaaacatgagtacgaaagatgatgaatacgattatttatttaaagttgtccttattggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataccgagcaatcacggcggcctattatcgtggtgcagtcggtgctctactcgtctacgatatcgccaaacatctgacatacgaaaacgttgaacgttggttgcgcgaattgcgcgaccacgcagatcagaacattgtgatcatgttggtcggaaacaaatccgatctgaggcatttgcgcgccgtgctgacagaagaagctaaggctttcgccgaaagaaacggcctcagcttcatcgagacttcagccctagattcgaccaatgtcgataatgctttccaaaatatactcacagagatctatagaattgtttcccaaaaacagatca

SEQ ID NO: 256 - DNA, 28 bp, Diabrotica virgifera
ggaacgtatcggaagtaatgtgtctgtg

SEQ ID NO: 257 - DNA, 25 bp, Diabrotica virgifera
cacaatgttctgatctgcgtggtcg

SEQ ID NO: 258 - DNA, 504 bp, Diabrotica virgifera
ggaacgtatcggaagtaatgtgtctgtgataaatagtaaaaaatattaaagcgatattttcgtcgaaactgatatgtattaaatttatcttttgtgttattaaagagagttaaacgtagctaaagaagaaaaactattagtgatttaaacatgagtacgaaagatgatgaatacgattatttatttaaagttgtccttattggtgattctggtgtaggaaaaagtaacttattgtcaagatttactagaaatgaattcaatttggagtctaaatctactataggtgtcgaattcgctaccagaagtatacaggtggatggtaaaactattaaagcacaaatatgggacacggcaggtcaagagagataccgagcaatcacggcggcctattatcgtggtgcagtcggtgctctactcgtctacgatatcgccaaacatctgacatacgaaaacgttgaacgttggttgcgcgaattgcgcgaccacgcagatcagaacattgtg

SEQ ID NO: 259 - DNA, 1180 bp, Diabrotica virgifera
atttttgggtgtttctttgattgaacaaaaattacaagcgttttaaattcactaaatttgctttgaaatatacaaatagttaattctaggaaaatatataacctacatacagaatcatgtcttcccgcaaaaccgtaagccgccgtggtaccacaaagaaacgtgcccaaagagccacatccaatgtattcgcaatgtttgatcaggctcagattgctgagttcaaagaagccttcaatatgatcgaccagaaccatgatggttttgtagataaagaagatctgcatgatatgcttgcttccttaggtaaaaacccaactgatgactatctagatggcatgatgaatgaagctcctggtcccataaacttcaccatgttcttaactctctttggagaacgtctacaaggcacagacccagaagacgtaattaaaaacgcttttggctgctttgacgaagacaacaatggtgtcctcaacgaagaacgtctcagggagctcctcacgtccatgggtgatagattcactgacgatgaagttgacgagatgtacagggaggctcctattaagaatggcttgtttgattatgttgaattcacccgcattttaaagcacggggctaaggacaaggatgagcaataagagacgaattgatgatgaaaggatttgtaattaatatggaaagatgtcttagtttgaatgatttggattttcattccatttttgtgattagaaatatatgaaattcatcatactagaccatcaagtcttgtccgttgcagtatcttctgcacatagacatgtcatccttgaacaaaactgcaaaaatggatttgaaaaatggtaggttttgaatgaattaacagtctaattatatagacatcttgttattgtacttaacatctcttgcttgttattttaaagtattccttgaatgttttgaatagaaaacgacattttgtatattaaaactacaaatccaattgcatgttatcattataagatcgatatttttccttcaaagtatttttagcattgttagtcagcttattttgggtttttacaacttttggcaacgttttatttattcataagatttattgtaattataaattttatacctttatatatcatgtaattattcattaaaatattgaaccaaaaaaaaacccacgcgtccg

SEQ ID NO: 260 - DNA, 26 bp, Diabrotica virgifera
gagccacatccaatgtattcgcaatg

SEQ ID NO: 261 - DNA, 30 bp, Diabrotica virgifera
caacggacaagacttgatggtctagtatga

SEQ ID NO: 262 - DNA, 607 bp, Diabrotica virgifera
gagccacatccaatgtattcgcaatgtttgatcaggctcagattgctgagttcaaagaagccttcaatatgatcgaccagaaccatgatggttttgtagataaagaagatctgcatgatatgcttgcttccttaggtaaaaacccaactgatgactatctagatggcatgatgaatgaagctcctggtcccataaacttcaccatgttcttaactctctttggagaacgtctacaaggcacagacccagaagacgtaattaaaaacgcttttggctgctttgacgaagacaacaatggtgtcctcaacgaagaacgtctcagggagctcctcacgtccatgggtgatagattcactgacgatgaagttgacgagatgtacagggaggctcctattaagaatggcttgtttgattatgttgaattcacccgcattttaaagcacggggctaaggacaaggatgagcaataagagacgagttgatgatgaaaggatttgtaattaatatggaacgatgtcttagtttgaatgatttggattttcattccatttttgtgattagaaatatatgaaattcatcatactagaccatcaagtcttgtccgttg

SEQ ID NO: 263 - DNA, 966 bp, Diabrotica virgifera
gatctagtgaccagccttgaagctatttctacacagagtggtatagtgtctggtgtagttgataatctcacaagagccatgactcgattgtcggatagtcgtgcttctctcatcttatctgatggtgatattggattcgttgattaccaaacacgaatggtggactgtgcgaagagtatagctaaaatcgccggagaaattgctagcaaagctgccactgaccctcagaaggtggctcaattatctgcagatcttgcgcacaaatatgcacaactatctggcgatagtattggagctgcagcagctgccactaatgccgaagttgcaatcagactaagggaagttgttcaacaactgggtggcgcctgcgtagaactcgtccaaacaggaggccagtgcttagtccgaaaagatgacgtactcttgcgagaagtaggagattgctcacgcaacgtaactgagaaagtttcccgtgttcttgccacattacaaaacgaatccagaggtacccaagcttgcatcaatgcagcttccaccgtatctggtatcatcggcgatttagaaactaccatcatgtttgccactgccggaaatctcaatcccgaaagcgaacatgaatcgttcgctaatcacagagagaatatattgaagactgctaaggcgttggtagaggatactaagactttggtagctggcgcagcttcatcacaagaacaactggctgtagctgctcaaaattctgttgcgaccatagtacaattagccgaagtagtgaaattcggagcagccagcttaggcgttgacaatccagattcccaagtgatgcttatcaacgcagtacgtgacgttgccagtgctcttggtgacttgattcaagctactaaggctgctagcggcaagcccatcaacgatccggccatggctcatttaaaagacagcgcaaaggtgacggattctgaaactgat

SEQ ID NO: 264 - DNA, 30 bp, Diabrotica virgifera
ggtgtagttgataatctcacaagagccatg

SEQ ID NO: 265 - DNA, 26 bp, Diabrotica virgifera
cagtttcagaatccgtcacctttgcg

SEQ ID NO: 266 - DNA, 913 bp, Diabrotica virgifera
ggtgtagttgataatctcacaagagccatgactcgattgtcggatagtcgtgcttctctcatcttatctgatggtgatattggattcgttgattaccaaacacgaatggtggactgtgcgaagagtatagctaaaatcgccggagaaattgctagcaaagctgccactgaccctcagaaggtggctcaattatctgcagatcttgcgcacaaatatgcacaactatctggcgatagtattggagctgcagcagctgccactaatgccgaagttgcaatcagactaagggaagttgttcaacaactgggtggcgcctgcgtagaactcgtccaaacaggaggccagtgcttagtccgaaaagatgacgtactcttgcgagaagtaggagattgctcacgcaacgtaactgagaaagtttcccgtgttcttgccacattacaaaacgaatccagaggtacccaagcttgcatcaatgcagcttccaccgtatctggtatcatcggcgatttagaaactaccatcatgtttgccactgccggaaatctcaatcccgaaagcgaacatgaatcgttcgctaatcacagagagaatatattgaagactgctaaggcgttggtagaggatactaagactttggtagctggcgcagcttcatcacaagaacaactggctgtagctgctcaaaattctgttgcgaccatagtacaattagccgaagtagtgaaattcggagcagccagcttaggcgttgacaatccagattcccaagtgatgcttatcaacgcagtacgtgacgttgccagtgctcttggtgacttgattcaagctactaaggctgctagcggcaagcccatcaacgatccggccatggctcatttaaaagacagcgcaaaggtgacggattctgaaactg

SEQ ID NO: 267 - DNA, 846 bp, Diabrotica virgifera
ctctctttgagttgtcgcttttcgaggtatttagttgcaggcgtggtgtatacgttgaaatagtgatttttgttaaaagtgagtaaatatggcatcgaaatcaaaaaaagggtcaacaccgttagcttcacagcggccggcgagccccttaagtcctaccagacattctagattacaggagaagcatgaacttcagaatcttaacgaccgtttggcgggatatatagatcgagtaaggtatttagaaggtgaaaacaacagattaacgagggaaatacaaagtacccaggaaacagtaacaagggaagtttcaaacattaaatctatgtatgaccatgaattatcagatgctagaaaactattagacgagacccaccgtgaaaaagcacgtttagagatagatgttaaacgtcttttagaagagaatgacgaactcaagtctgagttagcaaagaagaacaaggatttggctctagctgagaattctgccaggatatacgagaccagatgtaacgagttacagctcaaagcaaatcaagcggctgctgatgctaagaaagctattgcagatgctaaggaacttgagaaagaacgtgataagctacgcaaacttcttgataatcatcgtaaacagttagaagaagaatcattagcgagagtggaagtcgaaaatgccaaccaaagtcttcgagaagagctgtcctttaaggatcagatccatcaacaacagttgacagaaactcgtactcgtcgtcaagtagaaatcagcgaaatcgacggtcgcctggcagaaaaatatgaggctaagcttcaagaggctctacaagaactcagagatcaatatga

SEQ ID NO: 268 - DNA, 31 bp, Diabrotica virgifera
gagaagcatgaacttcagaatcttaacgacc

SEQ ID NO: 269 - DNA, 29 bp, Diabrotica virgifera
gatttcgctgatttctacttgacgacgag

SEQ ID NO: 270 - DNA, 595 bp, Diabrotica virgifera
gagaagcatgaacttcagatcttaacgaccgtttggcgggatatatagatcgagtaaggtatttagaaggtgaaaacaacagattaacgagggaaacacaaagtacccaggaaacagtaacaagggaagtttcaaacattaaatctatgtatgaccatgaattatcagatgctagaaaactattagacgagacccaccgtgaaaaagcacgtttagagatagatgttaaacgtcttttagaagagaatgacgaactcaagtctgagttagcaaagaagaacaaggatttggctctagctgagaattctgccaggatatacgagaccagatgtaacgagttacagctcaaagcaaatcaagcggctgctgatgctaagaaagctattgcagatgctaaggaacttgagaaagaacgtgataagctacgcaaacttcttgataatcatcgtaaacagttagaagaagaatcattggcgagagtggaagtcgaaaatgccaaccaaagtcttcgagaagagctgtcctttaaggatcagatccatcaacaacagttgacagaaactcgtactcgtcgtcaagtagaaatcagcgaatc

SEQ ID NO: 271 - DNA, 901 bp, Diabrotica virgifera
tcaacacgtgtgaattaaaacaaattcaaaaacaaaaatgtccatccaagaaaaagttttaatgaaaaaaataaaaaagagggaaaagcagaaattaaaatttgttcaaaagaaagagtctgaaaagagcaaagaagttttagaaacagatctaccagagaaggcaaaagtgggaaatggcttgaaacgcttgcagagcaacgatgaaggaccttctaaaaaaaaaaagaagaaaaataaaaagaagaaagagaaaatagtcgaagaggaagatacagacgaagaacaaccagaggaagatgaaattgagtctgacattgaagatcaagagattgacaatggtgaagaagatacagatgaaaaatctgatttaggaaacaaattaccaggatccagtgctacattagaaattctcagtaaaagtacatttgactcattgacggataaagtatgtgaaaatactttgaaagccattgcagatatgggttttactactatgactgaaattcaagcaaaatctatacctccacttctggaaggtagagatttggttggggctgcaaaaacaggatctggaaaaactcttgcttttctcattcccgctgttgaacttatttataagttaaagtttatgccaagaaatggtactggtatcattatcatttcccccacacgagaattatcaatgcagacttttggagtattaaaagaactaatgaaatatcatcaccatacatacggtttggttatgggtggaactgcaagacaaacagaagcacaaaagctttccaaaggtattaatatcttagtagcaacgcctggtaggcttctggatcatcttcagaatactcctgacttcttgtataagaatttacaatgtttagtcattgacgaggctgac

SEQ ID NO: 272 - DNA, 22 bp, Diabrotica virgifera
ggaaatggcttgaaacgcttgc

SEQ ID NO: 273 - DNA, 27 bp, Diabrotica virgifera
ctgaagatgatccagaagcctaccagg

SEQ ID NO: 274 - DNA, 672 bp, Diabrotica virgifera
ggaaatggcttgaaacgcttgcagagcaacgatgaaggaccttctaaaaaaaaaaagaagaaaaataaaaagaagaaagagaaaatagtcgaagaggaagatacagacgaagaacaaccagaggaagatgaaattgagtctgacattgaagatcaagagattgacaatggtgaagaagatacagatgaaaaatctgatttaggaaacaaattaccaggatccagtgctacattagaaattctcagtaaaagtacatttgactcattgacggataaagtatgtgaaaatactttgaaagccattgcagatatgggttttactactatgactgaaattcaagcaaaatctatacctccacttctggaaggtagagatttggttggggctgcaaaaacaggatctggaaaaactcttgcttttctcattcccgctgttgaacttatttataagttaaagtttatgccaagaaatggtactggtatcattatcatttcccccacacgagaattatcaatgcagacttttggagtattaaaagaactaatgaaatatcatcaccatacatacggtttggttatgggtggaactgcaagacaaacagaagcacaaaagctttccaaaggtattaatatcttagtagcaacgcctggtaggcttctggatcatcttcag

SEQ ID NO: 275 - DNA, 512 bp, Diabrotica virgifera
  modified_base (370)..(452): n = a, c, g or t/u
atttagtccactgtacaaatgaaccaaatgtttcaattccacagctagcaaatttgttaatagaaagatcacagaatacaaactgggtagtagtttacaaggcattagttacagttcaccacatgatgtgttatggaaatgagagatttactcagtacctagcatccagtaacagtacatttcaacttagcaacttcttagataaagggggacttcaaggatatgacatgtctccatttattagaaaatattcacgatatctcaatgagaaggccttatcatacagaactacagccttcgacttttgcaaagttaaaagagggaaggattgatggcatgttaaggacaatgaacgcagataaattattanaaactcttcccactttacaanatcaactggatatcctattggaantttgatgttccgcanatgatttnnacaacggagtgantaatatgtgtttcatgttgctttttagggatttatacgcttatttttgctgtataatgat

SEQ ID NO: 276 - DNA, 28 bp, Diabrotica virgifera
caaatgaaccaaatgtttcaattccaca

SEQ ID NO: 277 - DNA, 32 bp, Diabrotica virgifera
cgtataaatccctaaaaagcaacatgaaacac

SEQ ID NO: 278 - DNA, 470 bp, Diabrotica virgifera
tgaaccaaatgtttcaattccacagctagcaaatttgttaatagaaagatcacagaatacaaactgggtagtagtttacaaggcattagttacagttcaccacatgatgtgttatggaaatgagagatttactcagtacctagcatccagtaacagtacatttcaacttagcaacttcttagataaagggggacttcaaggatatgacatgtctccatttattagaaaatattcacgatatctcaatgagaaggccttatcatacagaactacagccttcgacttttgcaaagttaaaagagggaaggatgatggcatgttaaggacaatgaacgcagataaattattaaaaactcttcccactttacaaaatcaactggatatcctattggaatttgattgttccgcaaatgatttaacaaacggagtgataaatatgtgtttcatgttgctttttagggatttatacg

SEQ ID NO: 279 - DNA, 978 bp, Diabrotica virgifera
  modified_base (918): n = a, c, g or t/u
cgcgtgggcgcgaacaggcgagaaaagacctcaaaggactcgaagacactgtcgccaaagaactacagactctgcacaacctgagaaaattgttcgtgcaagatttgcaggcacgtatgaagaaaaatctttcgtcggaagacaatgaggaagacggcggctctctggctcaaaaacagaagatatcgttcctcgaaaacaatctcgatcaattgacaaaagtccacaagcagttggtacgagacaacgcggatctgcgctgtgaacttcccaaactcgaaaagagactacgagctacgatggaaagagtcaaagcactggaaactgcactgaaggaagccaaagaaggcgcgatgagagaccggaaaagataccaatacgaggttgaccgcattaaagaggctgtgaggcagaagaacctcgcaagaagaggcccagcagccacaatcgctaaaccaatcagggcagggcaacacaacacggttaacgtagctggtaaccccgtcattagaactggaggcatcaacatggccaacagatcgaccgacgaccagaaacgtaggtctgttattggtggagataaagattgagtcgccagccatcttgtcaggtgcttgagacgtttttagtaagcaaaatccataaaactgtaataccaaaaatattgccgatacttcgcgcgagtctgtcgccagcagtttttggaacagacaagaaaaaaaattgctcctccagactcgctcttcaatgtgcttacagcttagatatttctgtagtataaggtgcacttcattgcattgaaaatgaaacaaattaatcgagtattgtaacagattgttggcaaattgttttaataaatcgttcattttttgttttcgatcacttctagcttcctgtcgaattaagtgttaacactanaaaacaatttgcttgctgttttatccttaaaacgttgcaacgtttacggcgattttttga

SEQ ID NO: 280 - DNA, 26 bp, Diabrotica virgifera
gaacaggcgagaaaagacctcaaagg

SEQ ID NO: 281 - DNA, 26 bp, Diabrotica virgifera
cacattgaagagcgagtctggaggag

SEQ ID NO: 282 - DNA, 741 bp, Diabrotica virgifera
gaacaggcgagaaaagacctcaaaggactcgaagacactgtcgccaaagaactacagactctgcacaacctgagaaaattgttcgtgcaagatttgcaggcacgtatgaagaaaaatctttcgtcggaagacaatgaggaagacggcggctctctggctcaaaaacagaagatatcgttcctcgaaaacaatctcgatcaattgacaaaagtccacaagcagttggtacgagacaacgcggatctgcgctgtgaacttcccaaactcgaaaagagactacgagctacgatggaaagagtcaaagcactggaaactgcaccgaaggaagccaaagaaggcgcgatgagagaccggaaaagataccaatacgaggttgaccgcattaaagaggctgtgaggcagaagaacctcgcaagaagaggcccagcagccacaatcgccaaaccaatcagggcagggcaacacaacacggttaacgtagctggtaaccccgtcattagaactggaggcatcaacgtggccaacagatcgaccgacgaccagaaacgtaggtctgttattggtggagataaagattgagtcgccagccatcttgtcaggtgcttgagacgtttttagtaagcaaaatccataaaactgtaataccaaaaatattgccgatacttcgcgcgagtctgtcgccagcagtttttggaacagacaagaaaaaaaattgctcctccagactcgctcttcaatgtg

SEQ ID NO: 283 - DNA, 876 bp, Diabrotica virgifera
ggaaaactggtcccttctgtttttctgatgtctcaaattttctgtcctaacttctaacacttgtttaaaatccgttgacatacttgctaatttggatggagtgctaagacaatgctactcgtgtgtgattgtagatgtttcccacttgatccctgcttctgtttcctagatacatcttgtaattgggctatttgttgattcaagttgctaagatcaccttttatgatatatgtgagttcttggatttctgatgttttgtcgtcaaataaagattttcgttttgccaacaatgtcaacttttccaatttagcataagtgctagctatatgccgtcccacattcttcgcaattagcataaactcgctatgactttgtataaccctcgatttcttcgggtccctagcagctactgccctagcaatgttcctgccttgtaatgtctgtatagtatttacaaattcactagttctgtctctggcagtcatgactaattctggttcagtgtagtcttcgatataatcttcctctaaatagtagtcagatgtaacattgtttggatacaccgtgtgtgactgattcgttttaggctgagggttagtccaataattatcgttacctactataacttggggctcagtttcagagccagctcgacgacgtctaggaagcattgcattcttaagaggctacaaagttaattttgaaagtagcacaaccatatttaaagcactagaatttcactttatattatatttttatcacctactgtagtatatatcatgactaattgtttaattgggtttaatatgtttaattacaattaataatgaactttactttttcttttgaaagtacacgtctatttgcccggacgcg

SEQ ID NO: 284 - DNA, 32 bp, Diabrotica virgifera
ggttgtgctactttcaaaattaactttgtagc

SEQ ID NO: 285 - DNA, 29 bp, Diabrotica virgifera
cgttgacatacttgctaatttggatggag

SEQ ID NO: 286 - DNA, 645 bp, Diabrotica virgifera
ggttgtgctactttcaaaattaactttgtagcctcttaagaatgcaatgcttcctagacgtcgtcgagctggctctgaaactgagccccaagttatagtaggtaacgataattattggactaaccctcagcctaaaacgaatcagtcacacacggtgtatccaaacaatgttacatctgactactatttagaggaagattatatcgaagactacactgaaccagaattagtcatgactgccagagacagaactagtgaatttgtaaatactatacagacattacaaggcaggaacattgctagggcagtagctgctagggacccgaagaaatcgagggttatacaaagtcatagcgagtttatgctaattgcgaagaatgtgggacggcatatagctagcacttatgctaaattggaaaagttgacattgttggcaaaacgaaaatctttatttgacgacaaaacatcagaaatccaagaactcacatatatcataaaaggtgatcttagcaacttgaatcaacaaatagcccaattacaagatgtatctaggaaacagaagcagggaccaagtgggaaacatctacaatcacacacgagtagcattgtcttagcactccatccaaattagcaagtatgtcaacg

SEQ ID NO: 287 - DNA, 883 bp, Diabrotica virgifera
cccgttacatcattttatcatatataaaatgattttaatttgtttataatgtttattaagtaaaagcatttcgccatcgtaacatgtctaagatttttgcgttatacggggaactatgtgccactcacccatgggaagttatttttactgtcatcaccttcactgtatgttttttgactttggataaaccgcaagggacaaaggcctttccacggactacctcaacatgtagcacctgcaccgaagaccattttatagccgccgatgtaatagtgatgacaataatcagatgtcttgccatactgtacagttatcatcaattcagaaatctcagaaaactaggatccaaatatatattaggttttgcaggactatttgtagtctgctccagtttcgtgtttatatctgcagtattaaacatcctccaaatcgaagtagcggacctaaaagatgctctgttctttttcttgttgctaatagatctctcaaaagctgttaaattggctcaatacgctctaactgcctcaaaccaagaagaaataagtaaaaacatagcaatgggagttgctgttttagggcctaccataacgctagatactatcgtagaaaccttagtaataggagtgggaactttgtcaggagttcagcgtctagaaatgctatcgtattttgcgtgtctgtcagtcattgtgaattatataattttgttaactttttacccagcttgtttagctttaatgttagatttaagcaaagtaagtgattattacaaacaagaacaagttaccagaatactagtggacgaaaaagataagtccaatccagctgcacaacgtgttaagatgattatgtctcttggactcacatagtacatattcatagt

SEQ ID NO: 288 - DNA, 28 bp, Diabrotica virgifera
gttatacggggaactatgtgccactcac

SEQ ID NO: 289 - DNA, 28 bp, Diabrotica virgifera
gactgacagacacgcaaaatacgatagc

SEQ ID NO: 290 - DNA, 586 bp, Diabrotica virgifera
gttatacggggaactatgtgccactcacccatgggaagttatttttactgtcatcaccttcactgtatgttttttgactttggataaaccgcaagggacaaaggcctttccacggactacctcaacatgtagcacctgcaccgaagaccattttatagccgccgatgtaatagtgatgacaataatcagatgtcttgccatactgtacagttatcatcaattcagaaatctcagaaaactaggatccaaatatatattaggttttgcaggactatttgtagtctgctccagtttcgtgtttatatctgcagtattaaacatcctccaaatcgaagtagcggacctaaaagatgctctgttctttttcttgttgctaatagatctctcaaaagctgttaaattggctcaatacgctctaactgcctcaaaccaagaagaaataagtaaaaacatagcaatgggagttgctgttttagggcctaccataacgctagatactatcgtagaaaccttagtaataggagtgggaactttgtcaggagttcagcgtctagaaatgctatcgtattttgcgtgtctgtcagtc

SEQ ID NO: 291 - DNA, 816 bp, Diabrotica virgifera
gatagtagtcaatcagccagccatgtggtagaaatcaaaatttatgctcgatctttataccacctccgcgttttcttccaaaaacaccggatgctgataaggaccagtattgtttcattaatttaaaacagatggatgggtgcactgtcaagttcagagaattcaattcgattatggtttagcgatacggtgacaataaatttgaattattgtcacatttatcaagaaagtgtacttaatttataaacagtctgtgataatatagagctgaatatctagaccagttattaacatgacgattaagaatatttgttgccttggcgctggttacgtaggtgggccaacctgcagtgtgatagctttaaaatgtaaagatattaaagtaacagttgctgatcttagcgaagaacgaatagctcaatggaactccgacagactcccaatttatgagcctggattagacaaagtagtacaagagtgcagaggtaggaatttattcttcaccactaaccttactcaagcaatattagatgctgacttgatatttatatcagtgaatacaccaacaaaactgaacggaaatggcaagggaagggcacctgatctaaaatacatagagggagcagcaagaatcatagctgatactgctcaaactaacaaaatcgttgtagaaaaaagtactgttccagtacgagcagctgaaagtatttcagatatcttaacagctaataaaaagccaaaagtgacacatcagattttgtctaatccagaatttctagcggaaggtactgcaatcaatgatctgctcatcctgat

SEQ ID NO: 292 - DNA, 28 bp, Diabrotica virgifera
gatagtagtcaatcagccagccatgtgg

SEQ ID NO: 293 - DNA, 27 bp, Diabrotica virgifera
gcagtaccttccgctagaaattctgga

SEQ ID NO: 294 - DNA, 792 bp, Diabrotica virgifera
gatagtagtcaatcagccagccatgtggcagaaatcaaaatttatgctcgatctttataccacctccgcgttttcttccaaaaacaccggatgctgataaggaccagtattgtttcattaatttaaaacagatggatgggtgcactgtcaagttcagagaattcaattcgattatggtttagcgatacggtgacaataaatttgaattattgtcacatttatcaagaaagtgtacttaatttataaacagtctgtgataatatagagctgaatatctagaccagttattaacatgacgattaagaatatttgttgccttggcgctggttacgtaggtgggccaacctgcagtgtgatagctttaaaatgtaaagatattaaagtaacagttgctgatcttagcgaagaacgaatagctcaatggaactccgacagactcccaatttatgagcctggattagacaaagtagtacaagagtgcagaggtaggaatttattcttcaccactaaccttactcaagcaatattagatgctgacttgatatttatatcagtgaatacaccaacaaaactgaacggaaatggcaagggaagggcacctgatctaaaatacatagagggagcagcaagaatcatagctgatactgctcaaactaacaaaatcgttgtagaaaaaagtactgttccagtacgagcagctgaaagtatttcagatatcttaacagctaataaaaagccaaaagtgacacatcagattttgtctaatccagaatttctagcggaaggtactgc

SEQ ID NO: 295 - DNA, 1215 bp, Diabrotica virgifera
cggacgcgtggggttgaaagttaggttaactccttcactaaacttgctcttgttgtagatacacgtgtttacagcaaataagttattttttaagtatattgactgcaaattttcacaatggctaacgatttagaacaaaagatcatcaaacaaatcgaatattacttcggagacatcaatctgccgcgtgataaattcttacaagagaaaatcaaagaagatgaagggtggatcactctggatgtcttattaacgttcaaacgtctttcgtcgttatctactgaccaagaattaatcgcaaaagcagttgaaaagtctgaaaatggcctagtgatggtaagcgaagaccgtaagaaacttagacgcaatccagagaaaccgagtccagaattgaatgaggaaagacgcaaagagatcatggggaggacagcctacgcaaaaggatttccattggatgaagaatttaacaacattatcactttcctagatgcatatggaccagtcgaatcatgcagtcgtagatccaccaaagaccataaatttaagggttcctgttttattattttcaaagatgtcgaaacctgcaagaaattcgtagaagcggaaagtatcaaatatggagaaacagaactaatcaggaaattccaacaagtatattttgacgacaaaaaaaaagagatacaggacagaaaaaacgagaaagctgctagcaaggtagctgcaaaatcgggcacaccgcttcagtttcccaaaggagccattattcatttctctggaatcgaggaaggtgtaaaattattgagggaagatcttaaagaaaaggtcaaggaagtcggcaaaattgaagtaaaattcgttgattttaatcaaggtgatttggagggatacctacgtttcgcagaagaaaacgaagctgtcgagttctttaagacagttgataatgacacacttgaaattaaagatcaaaaagtcaaattgagagtgttagaaggagacgaagaggaggaatatctgaagaaaacttcagattctattctaaacatgagaaaacataagaaacaaaattctaataacagaaaacgaaagggcaactttggtggcggaagaagagatgctaaagttagtaaaagggactaataaacaaaatatgttatcatctttatctaattgtttagatattgtaaaaattaggttaaaaataaaggttttttttac

SEQ ID NO: 296 - DNA, 30 bp, Diabrotica virgifera
caagagaaaatcaaagaagatgaagggtgg

SEQ ID NO: 297 - DNA, 34 bp, Diabrotica virgifera
ccaaagttgccctttcgttttctgttattagaat

SEQ ID NO: 298 - DNA, 895 bp, Diabrotica virgifera
caagagaaaatcaaagaagatgaagggtggatcactctggatgtcttattaacgttcaaacgtctttcgtcgttatctactgaccaagaattaatcgcaaaagcagttgaaaagtctgaaaatggcctagtgatggtaagcgaagaccgtaagaaacttagacgcaatccagagaaaccgagtccagaattgaatgaggaaagacgcaaagagatcatggggaggacagcctacgcaaaaggatttccattggatgaagaatttaacaacattatcactttcctagatgcatatggaccagtcgaatcatgcagtcgtagatccaccaaagaccataaatttaagggttcctgttttattattttcaaagatgtcgaaacctgcaagaaattcgtagaagcggaaagtatcaaatatggagaaacagaactaatcaggaaattccaacaagtatattttgacgacaaaaaaaaagagatacaggacagaaaaaacgagaaagctgctagcaaggtagctgcaaaatcgggcacaccgcttcagtttcccaaaggagccattattcatttctctggaatcgaggaaggtgtaaaattattgagggaagatcttaaagaaaaggtcaaggaagtcggcaaaattgaagtaaaattcgttgattttaatcaaggtgatttggagggatacctacgtttcgcagaagaaaacgaagctgtcgagttctttaagacagttgataatgacacacttgaaattaaagatcaaaaagtcaaattgagagtgttagaaggagacgaagaggaggaatatctgaaaaaaacttcagattctattctaaacatgagaaaacataagaaacaaaattctaataacagaaaacgaaagggcaacttgg

SEQ ID NO: 299 - DNA, 822 bp, Diabrotica virgifera
  modified_base (807): n = a, c, g or t/u
caattagctcaaagagccagagacgagagagctgggattaaggcagctcctagtcattccaagggaggcgtggacgaggaagaacacgaaagagacttgcttcgtcaagatcgtcataaagagcgagctcgagatcgtaatttagcgcgtgcagctcccgataagcgcagtaaacttcagcgagagcgcgaaagagacatctcagaacaaattgctctcggtatgccagcgaaaggtgcaccatccaacgacactcagtttgatcaaagattatttggtcaggctcaaggtcttggtcacggctatggggatgatgaagcttataatgtctatgataaaccttggagagatggaggatccatggcaaatcacatttatcgaccaagtaaaaatattgataaagatatgtatggtggagaagacattgaaaaagctattagaactaataggtttgtaccagataaagaatttgggggtactgatcgttctggagcaggccgatcaggtcctgtgcaattcgaaaaagaagaagatccgttcggattggatcagttcttgtcgcaagctaagagagccagtaaaagaaaagaacctgaaaagagagacgacagggataagaggaaaagaagagagtaaaagtattttacagtttctttttgagacctttataaaataaatataggtatactggtatacataattctgatgtatttttaaaaaagttatatttgatattatgtaactaattgtaataggtaaactcaacaatacatttttcagataatttttgtgaattattgtaattanatatctataacacac

SEQ ID NO: 300 - DNA, 23 bp, Diabrotica virgifera
caagggaggcgtggacgaggaag

SEQ ID NO: 301 - DNA, 32 bp, Diabrotica virgifera
ctctcttcttttcctcttatccctgtcgtctc

SEQ ID NO: 302 - DNA, 573 bp, Diabrotica virgifera
cagggaggcgtggacgaggaagaacacgaaagagacttgcttcgtcaagatcgtcataaagagcgagctcgagatcgtaatttagcgcgtgcagctcccgataagcgcagtaaacttcagcgagagcgcgaaagagacatctcagaacaaattgctctcggtatgccagcgaaaggtgcaccatccaacgacactcagtttgatcaaagattatttggtcaggctcagggtcttggtcacggctatggggatgatgaagcttataatgtctatgataaaccttggagagatggagggtccatggcaaatcacatttatcgaccaagtaaaaatattgataaagatatgtatggtggagaaaacattgaaaaagctattagaactaataggtttgtaccagataaagaatttgggggtactgatcgttctggagcaggccgatcaggtcctgtgcaattcgaaaaagaagaagatccgttcggattggatcagttcttgtcgcaagctaagagagccagtaaaagaaaagaacctgaaaagagagacgacagggataagaggaaaagaagagag

SEQ ID NO: 303 - DNA, 755 bp, Diabrotica virgifera
aatgataactttgggtggggatgctgattttgaaatggttgatacgtatgatccattttcagagggaattcagtttaatgtgaggcctccgaaaaaatcttggaagaaaatttctaacttatctggaggagaaaaaacgttatcatctttggcccttgtctttgctctgcattattacaaaccttcgccactttatgtaatggacgaaattgacgcagccttagatttcaaaaatgtgtcaattgttggaaattatattaagcaacgtaccaaaaacgctcaattcattataatctcccttcgatccaacatgttcgaactgtgcgataatctcataggaatttacaaaacgtacgattgcacgaagtctataacgatagatccaagagtatatgacgagcaaacaaaacataacgaaaagcgagtgtcgcttggatcgaccaacgaagagagtagacgaacgtctgtgcccgcttctggtactggagattctggagataaaaatccagaaagaaatgttagcaatgaagttgtagacgaacaacgttcgaacttgatggaggttgataatgtcatccagagtacaaataatgccagggattcatctggtctgtctagtagcatgagtgaaaatgaaaatagtttacaagaatcccaagtgcctgaaatatgaaggggtcagtttcgtgatttagttactacttcttgatataaatgtagcatttttagttactttaatacatttacatatttgt

SEQ ID NO: 304 - DNA, 28 bp, Diabrotica virgifera
ggatgctgattttgaaatggttgatacg

SEQ ID NO: 305 - DNA, 29 bp, Diabrotica virgifera
cttcatatttcaggcacttgggattcttg

SEQ ID NO: 306 - DNA, 656 bp, Diabrotica virgifera
ggatgctgattttgaaatggttgatacgtatgatccattttcagagggaattcagtttaatgtgaggcctccgaaaaaatcttggaagaaaatttctaacttatctggaggagaaaaaacgttatcatctttggcccttgtctttgctctgcattattacaaaccttcgccactttatgtaatggacgaaattgacgcagccttagatttcaaaaatgtgtcaattgttggaaattatattaagcaacgtaccaaaaacgctcaattcattataatctcccttcgatccaacatgttcgaactgtgcgataatctcataggaatttacaaaacgtacgattgcacgaagtctataacgatagatccaagagtatatgacgagcaaacaaaacataacgaaaagcgagtgtcgcttggatcgaccaacgaagagagtagacgaacgtctgtgcccgcttctggtactggagattctggagataaaaatccagaaagaaatgttagcaatgaagttgtagacgaacaacgttcgaacttgatggaggttgataatgtcatccagagtacaaataatgccagggattcatctggtctgtctagtagcatgagtgaaaatgaaaatagtttacaagaatcccaagtgcctgaaatagaag

SEQ ID NO: 307 - DNA, 428 bp, Diabrotica virgifera
cggacgcgtgggctgaaatccaaattttttataaatataaccttaaagaagtctgtaaagatttaagcatgatttaacgaaatattaaatttttaactttaaaatgccgaactcagatattgatgataacgaaaaagtaactgggcccgtcgacaatgcatgggaactgaaaattccagaattcaaaccagaagataatccacatggattattagaggaaagtagtttcgccacattatttccacaatacagagaacaatatttaagacaagtatggcctttagttaagaaaactctgggtgaatataatataaaagcagaactagatgttgtagaaggtagtatgactgttaaaaccacaaggcaaacatgggatccttacattattattaaagcaagagatgtgataaagttaatgtctagaagtg

SEQ ID NO: 308 - DNA, 36 bp, Diabrotica virgifera
cgaactcagatattgatgataacgaaaaagtaactg

SEQ ID NO: 309 - DNA, 34 bp, Diabrotica virgifera
catgtttgccttgtggttttaacagtcatactac

SEQ ID NO: 310 - DNA, 265 bp, Diabrotica virgifera
cgaactcagatattgatgataacgaaaaagtaactgggcccgtcgacaatgcatgggaactgaaaattccagaattcaaaccagaagataatccacatggattattagaggaaagtagtttcgccacattatttccacaatacagagaacaatatttaagacaagtatggcctttagttaagaaaactctgggtgaatataatataaaagcagaactagatgttgtagaaggtagtatgactgttaaaaccacaaggcaaacatg

SEQ ID NO: 311 - DNA, 657 bp, Diabrotica virgifera
acgcgtccgcccacgcgtccgcgactgccggccattatttgtaagcggcgaaagattcggcgttgctttgtaaaattgttgtgaatctaccggcatcaaaagcctaaaaagcgtgtagcttttacgtagttatttaactgtagctactttacaaatttcatcaaaatgggcgatgaaaagaaggccagcgatagcgaacacattaatctcaaagtacttggtcaggataatgcagtggtacaattcaaaatcaaaaaacacaccccattaaaaaaattgatgaccgcctattgtgaacgtgctggtataagcacacaagtagtcagatttagatttgatggcaaccccataaacgacacagatactcctaattctttagagatggatgaaggagacacaattgaagtatatcaacaacagacaggtggtttcttctatcggtttctattcatttaaataatcacactgtattgttcttgtattttcttatttgctaaattaaactagttttaaataagtaagttaattttaatataatttttaattcatgtcaactgaagttacaatagttctgtaagaattcgactatttgtgtttttggactcttattttgtaattaaaacacttagaatacaaacatttttcttataaaaaaaa

SEQ ID NO: 312 - DNA, 29 bp, Diabrotica virgifera
gaaagattcggcgttgctttgtaaaattg

SEQ ID NO: 313 - DNA, 31 bp, Diabrotica virgifera
gaatagaaaccgatagaagaaaccacctgtc

SEQ ID NO: 314 - DNA, 401 bp, Diabrotica virgifera
gaaagattcggcgttgctttgtaaaattgttgtgaatctaccggcatcaaaagcctaaaaagcgtgtagcttttacgtagttatttaactgtagctactttacaaatttcatcaaaatgggcgatgaaaagaaggccagcgatagcgaacacattaatctcaaagtacttggtcaggataatgcagtggtacaatttaaaatcaaaaaacacaccccattaaaaaaattgatgaccgcctattgtgaacgtgctggtataagcacacaagtagtcagatttagatttgatggcaaccccataaacgacacagatactcctaattctttagagatggatgaaggagacacaattgaagtatatcaacaacagacaggtggtttcttctatcggtttctattc

SEQ ID NO: 315 - DNA, 822 bp, Diabrotica virgifera
aaacgacgattcagtgcaccgacgcaacgtacgccagccaattgtccctagagaatcccaaaggattttctagagatgcttttggaaggcagagtatgtcagagaagaggcatgcgacgttggatgccaagaataccgacacatatcagaaatcgaagaagattagggaggagaggaagatgaaagaaataaatgctgataaattaggccaattaggaccaagtttaggcatgaagaaatcttcaagcttggaatcgttacagacaatggtacaagagattcaaatgcaagaagaaggcgacccagcttatagttatagaggacccaatggagctttaaaagtaatcagggggaaaggctgtgaagaaagctttagggcagctgtagtggatccaaatcaccgaagtgagatcggagccaaaaagcattggttgcttgacggtccaatggaaaacgaacgagaagtggatggcttcagcaatgctcgaggaggtcctaggcaatcttctctgaatgcagctattgatataaagaataaatcagcaaagaagaaacctggtatatttaaaggcattggttcgatgttcaggtttggcaaacatcgtaaactggacttccaaacagcagaggctgcccaacactatcatcatacaaacgaattcgattcaaatgccaacgtacctcaacaacacaccgcagataccgaaaaccgaacgcaaagtagtcaaacagaacggacgcaagagcattcacaaaaagtacctctaaatagcaacccccagaaccaaaacacttcccaaggatctcaccaccagacgcaag

SEQ ID NO: 316 - DNA, 32 bp, Diabrotica virgifera
gatgccaagaataccgacacatatcagaaatc

SEQ ID NO: 317 - DNA, 25 bp, Diabrotica virgifera
cttgcgtctggtggtgagatccttg

SEQ ID NO: 318 - DNA, 700 bp, Diabrotica virgifera
gatgccaagaataccgacacatatcagaaatcgaagaagattagggaggagaggaagatgaaagaaataaatgctgataaattaggccaattaggaccaagtttaggcatgaagaaatcttcaagcttggaatcgttacagacaatggtacaagagattcaaatgcaagaagaaggcgacccagcttatagttatagaggacccaatggagctttaaaagtaatcagggggaaaggctgtgaagaaagctttagggcagctgtagtggatccaaatcaccgaagtgagatcggagccaaaaagcattggttgcttgacggtccaatggaaaacgaacgagaagtggatggcttcagcaatgctcgaggaggtcctaggcaatcttctctgaatgcagctattgatataaagaataaatcagcaaagaagaaacctggtatatttaaaggcattggttcgatgttcaggtttggcaaacatcgtaaactggacttccaaacagcagaggctgcccaacactatcatcatacaaacgaattcgattcaaatgccaacgtacctcaacaacacaccgcagataccgaaaaccgaacgcaaagtagtcaaccagaacggacgcaagagcattcacaaaaagtacctcaaaatagcaacccccagaaccaaaacacttcccaaggatctcaccaccagacgcaag

SEQ ID NO: 319 - DNA, 1321 bp, Diabrotica virgifera
ttagccaagcggcatggaagtaaagacccaaaggagctctgttttcattgtaatgcctatcgaaattataatttaagaagttataaaattgatctccagtaagaatgttggaacatgagtcaaccatggcacaacctggtaaatactcatcattttcaggatcttctcttctatctagttcgttaagtaccatttcccatactgcatgtgatcttgttgggcaattttggaggtttccgtgacatctgtgtggcattctaaaatacatagtatagggccatagtggtgggttatttaagggtgcggtgatagtggagtcgtataagaaggcttcttcttccatcatagtaaattggttgttacctcctactcttagataaggggctcttactcctactacgctgttatcggtaatattggcgaatttctcagtgatgactcgcatacctcccatttctttaacccagtcatttacactggcgttggaccagaagttttcgtcatcattgtgcgatattgaatgtactgcgatttcgtgaccttttctatgcatttcttggactgccgagtagttggtgtacttgtgagacacgaagaatgtagccttgatatgacaaccgttggggtttttccgttcaccgttgaaaatgttcttgtatagaccgatgttgttattatttatggcgtcgtcaaatgtgacagttatcatttgaggtacatctttggctggtaaatcattgggaatgcctgtaccgtcctctgagcagaaacaatcagggagaacgcatactgcggggtcgcagggtggggcactattggggtcactatcgatatcgcaggtagtttcatcagacccatcctggcaatccttttccccgttacaaaagagccctctttctatacactgaccatctccgcaggccaattcaccttcgttacatacgggtttgtccgtaaacaacatgggttttacccgccgctctttgtttttcaatttgcagtttttaactgagtccttccagtcgcatgtttgcttttcgatgtcgaaatatagaccggctggacaacgaatggcttgcaggcccgaagatgtacattgaatgacgtctcgacaggtgtccccctcccctcccactaaacgaaaccactcgcccgcgtctttgtctttgcatatttcggcctcgaaactctcctctttcttcggttcatcgtctttggcctgctgttgtgccaaaccgcttgaggctaccaacgcaaccaagaaaatcgtcgttgcgaagtacgccatgacacttaaacaactgaaagtaccggacgcaca

SEQ ID NO: 320 - DNA, 29 bp, Diabrotica virgifera
cagttgtttaagtgtcatggcgtacttcg

SEQ ID NO: 321 - DNA, 25 bp, Diabrotica virgifera
ggaggtttccgtgacatctgtgtgg

SEQ ID NO: 322 - DNA, 1075 bp, Diabrotica virgifera
cagttgtttaagtgtcatggcgtacttcgcaacgacgattttcttggttgcgttggtagcctcaagcggtttggcacaacagcaggccaaagacgatgaaccgaagaaagaggagagtttcgaggccgaaatatgcaaagacaaagacgcgggcgagtggtttcgtttagtgggaggggagggggacacctgtcgagacgtcattcaatgtacatcttcgggcctgcaagccattcgttgtccagccggtctatatttcgacatcgaaaagcaaacatgcgactggaaggactcagttaaaaactgcaaattgaaaaacaaagagcggcgggtaaaacccatgttgtttacggacaaacccgtatgtaacgaaggtgaattggcctgcggagatggtcagtgtatagaaagagggctcttttgtaacggggaaaaggattgccaggatgggtctgatgaaactacctgcgatatcgatagtgaccccaatagtgccccaccctgcgaccccgcagtatgcgttctccctgattgtttctgctcagaggacggtacaggcattcccaatgatttaccagccaaagatgtacctcaaatgataactgtcacatttgacgacgccataaataataacaacatcggtctatacaagaacattttcaacggtgaacggaaaaaccccaacggttgtcatatcaaggctacattcttcgtgtctcacaagtacaccaactactctgcagtccaagaaatgcatagaaaaggtcacgaaatcgcagtacattcaatatcgcacaatgatgacgaaaacttctggtccaacgccagtgtaaatgactgggttaaagaaatgggaggtatgcgagtcatcactgagaaattcgcaaatattaccgataacagcgtagtaggagtaagagccccttatctaagagtaggaggtaacaaccaatttactatgatggaagaagaagccttcttatacgactccactatcaccgcaccattaaataacccaccactatggccctatactatgtatttcagaatgccacacagatgtcaggaaacctcc

SEQ ID NO: 323 - DNA, 1703 bp, Diabrotica virgifera
  modified_base (1641): n = a, c, g or t/u
tgaaagtcaacattggtgaagagtagtactgtccaacggagcatgcgcagtgcgaaaaaagcacttgtataaataaaacgaaagtctgcgatcacttcttggctagtgcttgaaatttcagcatggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtgatctcaattcagatcttaagggcggtactcgattggcagcggtaaaatgtccgacaggacttgcttttgatcttttccgacaaacttgcgattggaaagtcaatgtcaaaaattgtgatatcgtagaaaaaccaagaaaagtccttccaattttgaaaaccgacgaaccaagatgtccagaaggaaagctgatgtgtggtaatgaagaatgtatcgacaaagatcttttctgtaatggaaagccagactgtaaagatgaatcagacgagaatgcatgcgatgttgatagtgatcccaaccgtgcacctgactgtgacccaactcaatgtgtaattccggactgtttctgctcagcggacggaactagaattcctggcgcgctagaaccagcaaatgtaccacaaatgataaccatttcgttcaatggtgccgttaatgtagataacatcgatctatatgaagaaatcttttcaggcactagacttaatccaaatggttgccaaattaaaggaaatttcttcgtttctcacaaatacacaaactactcagcagtacaggacctacacagacgtggtcatgaaatcgcggtgttttcattgactcataaagaggatccaaactactggtcccagggttcttatgacgactggttggctgaaatggctggagctagattgattattgaaagatttgccaacattaccgatggatcaataattggagtgagagctccatacctcagagtaggaggaaacagacaatttgaaatgatgacagatcaattctttatttatgattcatcaattacagcctctcttggacgtgtcccaatctggccttatactttatacttcaggatgccacataagtgcaacggaaatgcccacaactgtcccagcagaagccatcccgtttgggaaatagtcatgaacgaattggacagacgtgatgatcctacttttgacgaatcactacctggttgccacatggtagactcctgttctaatgttcaaactggagatcaatttgcaagactactcagacacaatttcaacagacatttgaattcaaaccgagctccgttgggtcttaacttccatgcctcatggttaaagagtaagaaagaattcaaagaagaacttattaaattcattgaagatatgttggcccgaaatgatgtttatttcgtaacaaacagtcaagtcatccaatgggttcagaatcccacagaactcagtggattaagagacttccaagaatggaaagaaaagtgtgacattaaaggtcaaccttactgttcattgcccaattcatgtccattacataccagagaactgccanggtgaactctacgattgtttacctgtatggaatgtcccaacaattatccatggattttggat

SEQ ID NO: 324 - DNA, 28 bp, Diabrotica virgifera
gacgaaccaagatgtccagaaggaaagc

SEQ ID NO: 325 - DNA, 30 bp, Diabrotica virgifera
gttgggacattccatacaggtaaacaatcg

SEQ ID NO: 326 - DNA, 1221 bp, Diabrotica virgifera
  modified_base (271)..(358): n = a, c, g or t/u
gacgaaccaagatgtccagaaggaaagctgatgtgtggtaatgaagaatgtatcgacaaagatcttttctgtaatggaaagccagactgtaaagatgaatcagacgagaatgcatgcgatgttgatagtgatcccaaccgtgcacctgactgtgacccaactcaatgtgtaattccggactgtttctgctcagcggacggaactagaattcctggcgcgctagaaccagcaaatgtaccacaaatgataaccatttcgttcaatggtgccngttaatgtagataacatcgatctatatgaagaaatcttttcaggcactagacttaatccaaatggttgccaaattaaaggaaatttncttcgtttctcacaaatacacaaactactcagcagtacaggacctacacagacgtggtcatgaaatcgcggtgttttcattgactcataaagagggtccaaactactggtcccagggttcttatgacgactggttggctgaaatggctggagctagattgattattgaaagatttgccaacattaccgatggatcaataattggagtgagagctccatacctcagagtaggaggaaacagacaatttgaaatgatgacagatcaattctttatttatgattcatcaattacagcctctcttggacgtgtcccaatctggccttatactttatacttcaggatgccacataagtgcaacggaaatgcccacaactgtcccagcagaagccgtcccgtttgggaaatagtcatgaacgaattggacagacgtgatgatcctacttttgacgaatcactacctggttgccacatggtagactcctgttctaatgttcaaactggagatcaatttgcaagactactcagacacaatttcaacagacatttgaattcaaaccgagctccgttgggtctcaacttccatgcctcatggttaaagagtaagaaagaattcaaagaagaacttattaaattcattgaagatatgttggcccgaaatgatgtttatttcgtaacaaacagtcaagtcatccaatgggttcagaatcccacagaactcagtggattaagagacttccaagaatggaaagaaaagtgtgacattaaaggtcaaccttactgttcattgcccaattcatgtccattacataccagagaactgccaggtgaaactctacgattgtttacctgtatggaatgtccca

SEQ ID NO: 327 - DNA, 826 bp, Diabrotica virgifera
  modified_base (658)..(683): n = a, c, g or t/u
caaattgtttattacaagtttattaccatgagagtgtatataatattatttagcgtcttttgcttgagccattgcgctccacaggaaaacaaaaataaatttccagaacaataccaaggtcaacacataccaattgtaaggcaagaacaagaagtgaattatgatggcacctacgaatacaactttgaaactggaaatggcatagtccaagaagaaaaaggatttttgaaaaacgccggtacaaaggaagaagctcaagtcgctcaaggtttttcctcatatacttcccccgaaggagtaaaaatagaactccggtacatcgcagacgaaaacggtttccagccaatcggagaccacctaccgactccgccaccaatccctgaggctattttacgagcgctaagtgtactgaaacagttgggtaatttgaatgaagaccaagaagaaaataacaacattagatgaagagagagtgtgatcaaatcgttattttggataagtcccttcatatttcaaaatggtaccatactaactatgaaatacttcaaagaattaagatctttttaaaatacgtcaacactttagagtaggaaacagcggtggaacctcgcaaaatgtacacaagttcggttttatttttttgcaggaaaatcaaggngtgcttataatgaaactaacattttnctaaaaaatttcgcccctgaacccccctttttatccctttgaaggggggtatttgtggtttttgcgaaacgaagcccttcctgtatacgttttacaaaagaatgtactaaatagtaaaatgaagaggactataatttgctac

SEQ ID NO: 328 - DNA, 29 bp, Diabrotica virgifera
ccagaacaataccaaggtcaacacatacc

SEQ ID NO: 329 - DNA, 25 bp, Diabrotica virgifera
gaggttccaccgctgtttcctactc

SEQ ID NO: 330 - DNA, 505 bp, Diabrotica virgifera
agaacaataccaaggtcaacacataccaattgtaaggcaagaacaagaagtgaattatgatggcacctacgaatacaactttgaaactggaaatggcatagtccaagaagaaaaaggatttttgaaaaacgccggtacaaaggaagaagctcaagtcgctcaaggtttttcctcatatacttcccccgaaggagtaaaaatagaactccggtacatcgcagacgaaaacggtttccagccaatcggagaccacctaccgactccgccaccaatccctgaggctattttacgagcgctaagtgtactgaaacagttgggtaatttgaatgaagaccaagaagaaaataacaacattagatgaagagagagtgtgatcaaatcgttattttggataagtcccttcatatttcaaaatggtaccatactaactatgaaatacttcaaagaactaagatctttttaaaatacgtcaacactttagagtaggaaacagcggtggaacctc

SEQ ID NO: 331 - DNA, 731 bp, Diabrotica virgifera
ttggtaaagtttgttgtagtttcagtgatcttcattttgaactctttttttttttcaatatgcgaactacgtactttacattagttgtaatattagctgtagctgtacaagaacatgcatctcaacaattaccagtaacgcaagcttgcttgggatgtatatgtgaagctatttccaactgtaatgtaactagcggttgttctggtgaggtttgtggaccatttcggatcacctgggcatattgggcagatgctggaaagcccaccgtgaaaggagtatcaccagaagacaataatgcatatggatcttgtgctactgatacgtattgttctgcattagctgttcaaggatatatgaataaatttcaacaggattgcaatggtgatggtaaaatagactgtgacgattatgcaagtattcacacgcatggtggatatggctgcaaaggaactaatctaccacaaccttttggaaatcgatattatcaatgtaaagagatagttggacgtagaccagagtaatgttggagtaaccccaggattgagaacaggaagattgatagaaacgcatttactactctatgaattttgttggatgattattgcaacttaatgtaattcaatatgtttaagggctgtaattacaattaaataaaaataactgacatcatagaatacactattgtaacaactatttttttaggtatagtattttaagtaaactcttttttt

SEQ ID NO: 332 - DNA, 29 bp, Diabrotica virgifera
gcatctcaacaattaccagtaacgcaagc

SEQ ID NO: 333 - DNA, 32 bp, Diabrotica virgifera
gtttctatcaatcttcctgttctcaatcctgg

SEQ ID NO: 334 - DNA, 450 bp, Diabrotica virgifera
gcatctcaacaattaccagtaacgcaagcttgcttgggatgtatatgtgaagctatttccaactgtaatgtaactagcggttgttctggtgaggtttgtggaccatttcggatcacctgggcatattgggcagatgctggaaagcccaccgtgaaaggagtatcaccagaagacaataatgcatatggatcttgtgctactgatacgtattgttctgcattagctgttcaaggatatatgaataaatttcaacaggattgcaatggtgatggtaaaatagactgtgacgattatgcaagtattcacacgcatggtggatatggctgcaaaggaactaatctaccacaaccttttggaaatcgatattatcaatgtaaagagatagttggacgtagaccagagtaatgttggagtaaccccaggattgagaacaggaagattgatagaaac

SEQ ID NO: 335 - DNA, 878 bp, Diabrotica virgifera
gtgattgtggtgttttatcggtgttaagacaggatgggtttcggtcaaaaaattctagtccctctagtccttatagaaatgtccctactggttacatccagaataatatatgaccatcagcaagaagataatcacgaagggcaacaagttcaatacaccaattactatggtcacgaagagtctgccacaacagcacatttccaacaacccgtccagtttcccgaggaacatagccaaggtttgcacaaagaggaacacatcgattattacgcaccagccaagtattccttcaaatatggagtcaacgactaccacactggcgatataaaaagccaacacgaatccagagacggagatactgtcaaaggccaatacacacttgtagaacccgacggatctatcagaactgtagactacactgctgacaaacacagtggatttaacgcagtagtgcgcaaatcaggtcccacaaaacacatagaaggaaggcatctggaacaccaacccgaagaagagcaacatatacctcagcatcatttggcagaagatcatgttttaccgcagtatcaactggaacaccaacaggctttggaagaagatgttgaagaaggacatctggaagctgaagatgctagtcaatatgaagaagaagagcattaggtgttatattaagtttaaggacgtaatggtttgtaaataagcgaactcaaagattaaagtagtatcttttaaaattattggagaaaataagaatttttgtttgtaagaaaaagtatcatcatcaactatatttttttataacacttttaacattttgggaacgtaatattcgaatttatacactcacagacaaaaatcttgcatattttgaaattatg

SEQ ID NO: 336 - DNA, 27 bp, Diabrotica virgifera
ggtgttaagacaggatgggtttcggtc

SEQ ID NO: 337 - DNA, 28 bp, Diabrotica virgifera
ggtgttccagttgatactgcggtaaaac

SEQ ID NO: 338 - DNA, 560 bp, Diabrotica virgifera
ggtgttaagacaggatgggtttcggtcaaaaaattctagtccctctagtccttatagaaatgtccctactggttacatccagaataatatatgaccatcagcaagaagataatcacgaagggcaacaagttcaatacaccaattactatggtcacgaagagtctgccacaacagcacatttccaacaacccgtccagtttcccgaggaacatagccaaggtttgcacaaagaggaacacatcgattattacgcaccagccaagtattccttcaaatatggagtcaacgactaccacactggcgatataaaaagccaacacgaatccagagacggagatactgtcaaaggccaatacacacttgtagaacccgacggatctatcagaactgtagactacactgctgacaaacacagtggatttaacgcagtagtgcgcaaatcaggtcccacaaaacacatagaaggaaggcatctggaacaccaacccgaagaagagcaacatatacctcagcatcatttggcagaagatcatgttttaccgcagtatcaactgaacacc

SEQ ID NO: 339 - DNA, 831 bp, Diabrotica virgifera
  modified_base (807): n = a, c, g or t/u
ctcagttttgtcgacggtgttgatcgaagacgagtcatgaaatttttgattgttgccgcattggtgtttggagcctgttcggcagaaccacagaggcggcctcattcctactatgacaaccaggctgaacaagacacaaacgtcccacaaaactaccaagataactcagatcaataccaacagaattctgtccaacaaaacccaccgcaacatcaggaaaaatcgcaatatgaaccacgagtaaaagaaactatcaaattcataccaattatcagattcgataaagaacaaggagaagccggtaattacaaagctgcatatgaaaccggaaacaacattatcgctgaagaagaaggttacttgaaggaactcggtccagatccagaccagcaaggacaagttatcaaatcgcaagtacaacagggtcacttcacatatacatcccctgaaggagtagttattgaaactaaatatactgctgacgaaaacggtttccatgttgaaggagatcatttgccaaccccaccaccagttagcgccgaagtacaaaagggattggaccttatttttgctggtatcagagctcaacaggaggcgttagaacaaagattaaaagatcacccagaagaaagagacagacctgaaaattacgacgatggtcaataccgaccggcacaacaggagtaattttactctttatttatagtttagcaccatcattctgtgattttgtcgtcatttctatagaatatcttctgtacagactgaataagattgataatacactgtggaaaaaaaattgataanaatcaataaaaatctttttacaca

SEQ ID NO: 340 - DNA, 24 bp, Diabrotica virgifera
gattgttgccgcattggtgtttgg

SEQ ID NO: 341 - DNA, 27 bp, Diabrotica virgifera
gacgacaaaatcacagaatgatggtgc

SEQ ID NO: 342 - DNA, 690 bp, Diabrotica virgifera
gattgttgccgcattggtgtttggagcctgttcggcagaaccacagaggcggcctcattcctactatgacaaccaggctgaacaagacacaaacgtcccacaaaactaccaagacgactcagatcaataccaacagaattctgtccaacaaaacccaccgcaacatcaggaaaaatcgcaatatgaaccacgagtaaaagaaactatcaaattcataccaattatcagattcgataaagaacaaggagaagccggtaattacaaagctgcatatgaaaccggaaacaacattatcgctgaagaaggaggttacttgaaggaactcggtccagatccagactagcaaggacaagttatcaaatcgcaagtacaacagggtcacttcacatatacatcccctgaaggagtagttattgaaactaaatatactgctgacgaaaacggtttccatgttgaaggagatcatttgccaaccccgccaccagttagcgccgaagtacaaaagggattggaccttatttttgctggtatcagagctcaacaggaggcgttagaacaaagattaaaagatcacccagaagaaagagacagacctgaaaattacgacgatggtcaataccgaccggcacaacaggagtaattttactctttatttatagtttagcaccatcattctgtgattttgtcgtc

SEQ ID NO: 343 - DNA, 633 bp, Diabrotica virgifera
caacactatgttctctaaaattttgtcagtgttagccttcacagctttagcacaagctggcgttttagactacagtcacggccatgctacctcatatgcttcctcaaacctaggtggttcagaacatggacatggatattcagctccagttttaagtcacgcatatgctgcacctgttgctcacggatattctgctcctgttctcgcccacggacattccgcacatcacgatgtagattacaacgcttatcccaaatacgaattcaactacggagttcaagatggccacactggagaccacaaaactcaacacgaagtccgtgatggtgacgtagtcaaaggttcctacacagtagctgaacctgacggtactcttcgtactgtccactacactgctgatgaccacaacggtttcaatgctgttgttgaaaaatctggacacccagttcacccagctccagctcatggacacggaaaagtactcctagctgctcccgctgtccaccacgctccattgtaccatcattaaaacctgaaagatgcatgttgattattgttactgtatttattgactttgttgattgaattactatgtaattaatttttgtacataaaataaatttaattgaatat

SEQ ID NO: 344 - DNA, 27 bp, Diabrotica virgifera
ctaggtggttcagaacatggacatgga

SEQ ID NO: 345 - DNA, 30 bp, Diabrotica virgifera
caggttttaatgatggtacaatggagcgtg

SEQ ID NO: 346 - DNA, 421 bp, Diabrotica virgifera
ctaggtggttcagaacatggacatggatattcagctccagttttaagtcacgcatatgctgcacctgttgctcacggatattctgctcctgttctcgcccacggacattccgcacatcacgatgtagattacaacgcttatcccaaatacgaattcaactacggagttcaagatggccacactggagaccacaaaactcaacacgaagtccgtgatggtgacgtagtcaaaggttcctacacagtagctgaacctgacggtactcttcgtactgtccactacactgctgatgaccacaacggtttcaatgctgttgttgaaaaatctggacacccagttcacccagctccagctcatggacacggaaaagtactcctagctgctcccgctgtccaccacgctccattgtaccatcaaaacc

SEQ ID NO: 347 - DNA, 698 bp, Diabrotica virgifera
  modified_base (14): n = a, c, g or t/u
aacatggcattcanattagttgctttcgccgcattggtagcagtagctcgtgctggtgtcatcggagaagcctactctgcaccacttgcctatgcagctccagcagtagctaaggtagcctactcagccgctccagctgtatcatactcaagtgtgtcatcacctgtagcttacgcagcaccagctgttgctaaattagctgcacctgtatcttatgctgcaccagctttatcttacgctgcaccagtcgctaaagttgcctactcatcagctccagctgtctcttactccagtgtatccgcaccagtagcctacgccgctgccccagcctacgccaaagtagctgctccagtatcgtacgcagctccagctgtttcctacgccgctccagctctctcctatgccgccccagcccttaaagtagctgccccagtagcttatgccgctcctgttgccaaagcagtttacgccgaaccatcagcaccagctaactacgattttggatatgccgtaaacgacccccacaccggagatagcaaaagccaacaagaatctcgccacggtgatgttgtacatggaagctattcccttattgaagccgatggcagcaaacgtaccgtagaatacaccgctgatgaacacaatggttttaatgcagttgtacacaaggaaccagccacagttgcggttaaagcagt

SEQ ID NO: 348 - DNA, 25 bp, Diabrotica virgifera
gctcgtgctggtgtcatcggagaag

SEQ ID NO: 349 - DNA, 26 bp, Diabrotica virgifera
gcaactgtggctggttccttgtgtac

SEQ ID NO: 350 - DNA, 641 bp, Diabrotica virgifera
gctcgtgctggtgtcatcggagaagcctactctgcaccacttgcctatgcagctccagcagtagctaaggtagcctactcagccgctccagctgtatcatactcaagtgtgtcatcacctgtagcttacgcagcaccagctgttgctaaattagctgcacctgtatcttatgctgcaccagctttatcttacgctgcaccagtcgctaaagttgcctactcatcagctccagctgtctcttactccagtgtatccgcaccagtagcctacgccgctgccccagcctacgccaaagtagctgctccagtatcgtacgcagctccagctgtttcctacgccgctccagctctctcctatgccgccccagcccttaaagtagctgccccagtagcttatgccgctcctgttgccaaagcagtttacgccgaaccatcagcaccagctaactacgattttggatatgccgtaaacgacccccacaccggagatagcaaaagccaacaagaatctcgccacggtgatgttgtacatggaagctattcccttattgaagccgatggcatcaaacgtaccgtagaatacaccgctgatgaacacaatggttttaatgcagttgtacacaaggaaccagccacagttgc

SEQ ID NO: 351 - DNA, 977 bp, Diabrotica virgifera
attggaaatatagcaacatggccgtcaagattaccttcagcatccttatagcagttctattagccagaaacagggtcgatgcctcaggagttgcacctttatttgctccagcaccagtattagccccagcaccagttctagctccagctccagttttggccaaagtttctgatgccacaattgaccccaatcctgcatattcatttgcgtatgacgtgcaggatgccctaacaggagattcaaaaggacaagttgaaagcagagccaacggcgttgtaagaggacaatatcaagtagcagatccagacggtaccagaagaattgtagattattacgccgatcctgtgcatggattcaatgctgtggtcagaagagttcctctaggtgttgcagttgctcctgtcgtagccaaagctgtagctcctgttgctccaatcgctcccgtcgctagatcattagtccttcctgctccagggcttccagttgctgccgctcctgtaccagtagctccagcattacctttcgccgcaccagcagtagcaccagctcttccatttgccgctgctccagctgtagcaccagctcttccattcgcagctccagctgtagcaccagcattgccgtatgctgcagctccagctatttctccatacttaaccagagctggattcttcccagctccagctccagccgtagttcctgctgctccaggtcctgcatacttgcctgctgctccatcaagattggtttcaccctattcggtagccgcacccttgccttcaggtttgaggagtttagtgacccccttctcagcgggtcctgctccactagccgttggatcaggggtagcggcgccgtattggtaaaccccggccgtgtactaaatattgactgactatatattttttaagtagtttacatttgttttattgtttctagtatttttattgtaaataaatatcctatatttttatctt

SEQ ID NO: 352 - DNA, 32 bp, Diabrotica virgifera
caagattaccttcagcatccttatagcagttc

SEQ ID NO: 353 - DNA, 30 bp, Diabrotica virgifera
gtcactaaactcctcaaacctgaaggcaag

SEQ ID NO: 354 - DNA, 777 bp, Diabrotica virgifera
caagattaccttcagcatccttatagcagttctattagccagaaacagggtcgatgcctcaggagttgcacctttatttgctccagcaccagtattagccccagcaccagttctagctccagctccagttttggccaaagtttctgatgccacaattgaccccaatcctgcatattcatttgcgtatgacgtgcaggatgccctaacaggagattcaaaaggacaagttgaaagcagagccaacggcgttgtaagaggacaatatcaagtagcagatccagacggtaccagaagaattgtagattattacgccgatcctgtgcatggattcaatgctgtggtcagaagagttcctctaggtgttgcagttgctcctgtcgtagccaaagctgtagctcctgttgctccaatcgctcccgtcgctagatcattagtccttcctgctccagggcttccagttgctgccgctcctgtaccagtagctccagcattacctttcgccgcaccagcagtagcaccagctcttccatttgccgctgctccagctgtagcaccagctcttccattcgcagctccagctgtagcaccagcattgccgtatgctgcagctccagctatttctccatacttaaccagagctggattcttcccagctccagctccagccgtagttcctgctgctccaggtcctgcatacttgcctgctgctccatcaagattggtttcaccctattcggtagccgcacccttgccttcaggtttgaggagtttagtgac

SEQ ID NO: 355 - DNA, 1176 bp, Diabrotica virgifera
aaatctatcaaacttttatttatttagattcaaaatacgattatttatacattaacgttattaatccatgggtattcgtctggacaaggaacacacgcgtccatgtttctatcctctgttccttttttaagtctgcaggtgtaaggctcacaactggctccatcgggcgcgtcagcagttttaaaatcgctaattttaacgggattttttataaaatctaggacctgtttttgtgagacgaagaaggtatcttttgcttcacgtgcaactgtgttttccaagaattttcgaagcccatcgaagctggtgtcagtttgttcaaaccagtatgagttgatcatcaaatttatgggagttctagatttacttctaattccttcaatttgatcatccaaatatttggcgatttcatcaacactaccttctattccacaagtagccagtgaattgcattctgtaccatttggtgaagttaaatcgtttattggcagaatccaataacctgggaaagcttcgttaggacattctgcgcccaaaagacattgttctgttgattgataatccaatgtatagggaaataatcttcttgatggcaaagagggccatgaactatcatatgccaattctgatgctatataggcctcaatggaagtgtttcctgcaagttgtagttggggagttctgactccaataatagcttcagctggtatgttggcataagtacttataatttgcttttggcctttaaattcttttgttagtgtgtctagagttgcatatctccagtaattttgtctaaaatccttcgtaattgagtgcacaccaatttcaaatccaaagttgtacaaatcattaactctttgatagctcgtatactcatgtggtacaaagaatgttccactaattggcttatcatctggattatatatatttccgagcaatgtaatccaactgttgtcgtagatgtgttgtgtaacagcttcatcaaatgttaaactaatcagctgaggatactctgtgagatctccacctagaggtgacacttgactagaacatctacaattgttgccgatcgtacaagaatcagactcacacggttttgctacatcatttgcaatcgcactatcgaatgctaaagtagctacgagaactaaaatcaagcactggaacgttgcc

SEQ ID NO: 356 - DNA, 27 bp, Diabrotica virgifera
gcaaatgatgtagcaaaaccgtgtgag

SEQ ID NO: 357 - DNA, 27 bp, Diabrotica virgifera
ggtattcgtctggacaaggaacacacg

SEQ ID NO: 358 - DNA, 1043 bp, Diabrotica virgifera
ggatcgtctggacaaggaacacacgcgtccatgtttctatcctctgttccttttttaagtctgcaggtgtaaggctcacaactggctccatcgggcgcgtcagcagttttaaaatcgctaattttaacgggattttttataaaatctaggacctgtttttgtgagacgaagaaggtatcttttgcttcacgtgcaactgtgttttccaagaattttcgaagcccatcgaagctggtgtcagtttgttcaaaccagtatgagttgatcatcaaatttatgggagttctagatttacttctaattccttcaatttgatcatccaaatatttggcgatttcatcaacactaccttctattccacaagtagccagtgaattgcattctgtaccatttggtgaagttaaatcatttattggcagaatccaataacctgggaaagcttcgttaggacattctgcgcccaaaagacattgttctgttgattgataatccaatgtatagggaaataatcttcttgatggcaaagagggccatgaactatcatatgccaattctgatgctatataggcctcaatggaagtgtttcctgcaagttgtagttggggagttctgactccaataatagcttcagctggtatgttggcataagtacttataatttgcttttggcctttaaattcttttgttagtgtgtctagagttgcatatctccagtaattttgtctaaaatccttcgtaattgagtgcacaccaatttcaaatccaaagttgtacaaatcattaactctttgatagctcgtatactcatgtggtacaaagaatgttccactaattggcttatcatctggattatatatatttccgagcaatgtaatccaactgttgtcgtagatgtgttgtgtaacagcttcatcaaatgttaaactaatcagctgaggatactctgtgagatctccacctagaggtgacacttgactagaacatctacaattgttgccgatcgtacaagaatcagactcacacggttttgctacatcatttgc

SEQ ID NO: 359 - DNA, 649 bp, Diabrotica virgifera
ctattattcagatgtgccacaggtgaaaattggcctagcataatgttatcgtgtgtgaaaggcaagatgtgtgacgaaaattcgggaaaagacggacaccagtgtggtcacaatatagcttatgcctattttgtgtcatttatattcttctgttcgttcttgatgttaaacttgttcgtagccgtcattatggacaattttgattatttaacacgtgatccttccatattgggtgctcatcatttagacgaattcgttagaatttgggcagaatacgatccaaatgccacaggaaaaatccactacagcgaaatgtacgacatgttgaaaaatatggatccgccactaggctttggaaacaagtgtcctaatcgattagcgtataagaaattaattaggatgaacatgccagtagacgacgatgggaaagttaattttactacgacattctttgctctcgtcagagaaaatcttagcattaaaatgcgaacagctgatgaaatggaccaggccgatgacgaactcaaagagacaatcaaaaacatctggccgatccaagccaagaacatggtggagctgttggttccaccgaccaaccagctcaccaccggaaaatgtccgtcggcaagttatacgccggtcttctgat

SEQ ID NO: 360 - DNA, 32 bp, Diabrotica virgifera
ctattattcagatgtgccacaggtgaaaattg

SEQ ID NO: 361 - DNA, 30 bp, Diabrotica virgifera
cagatgtttttgattgtctctttgagttcg

SEQ ID NO: 362 - DNA, 547 bp, Diabrotica virgifera
ctattattcagatgtgccacaggtgaaaattggcctagcataatgttatcgtgtgtgaaaggcaagatgtgtgacgaaaattcgggaaaagacggacaccagtgtggtcacaatatagcttatgcctattttgtgtcatttatattcttctgttcgttcttgatgttaaacttgttcgtagccgtcattatggacaattttgattatttaacacgtgatccttccatattgggtgctcatcatttagacgaattcgttagaatttgggcagaatacgatccaaatgccacaggaaaaatccactacagcgaaatgtacgacatgttgaaaatatggatccgccactaggctttggaaacaagtgtcctaatcgattagcgtataagaaattaattaggatgaacatgccagtagacgacgatgggaaagttaattttactacgacattctttgctctcgtcagagaaaatcttagcattaaaatgcgaacagctgatgaaatggaccaggccgatgacgaactcaaagagacaatcaaaaacatctg

SEQ ID NO: 363 - DNA, 677 bp, Diabrotica virgifera
caataggtatggcctctgcgaaagatacggctacgttctttactcacggcacctgtcaacatttcgagcaggtcctcaagttatatccacaagcccttcgattgaaagctgatagaaaagccaaaaagcccgaggaactgattaaattagacaattggtatcagaatgaactaccgaaaaggatcaaaagtcgtggcaaagatgcccacttagtacacgaggagttggtacaatgcatgaaatggaaacagaccagggggaagttcttcccccaattatcgtatttggtaaaggttaacactcctagagctgttatggcagaaacgaagagagcctttagaaaattgcccaatcttgagttggcgatgtcagcgctctcaaatttgaaaggagtcggtaccacaatggcctcagcattactggcggctgcttgtccagacagcgccccctttatggcagatgaatgtctgatggccataccagacatcgaaggtattgattacaccaccaaggagtacctgaaattcgccaaccacatcaaatccgtcgtcgagagattaaacaaggccgcagaagaaaggtcagaggctgtacgttggtcgccacacaaggacgagttagctctttggacacctacgttgtctccgaacacaaaccagagttgctctctagtattt

SEQ ID NO: 364 - DNA, 27 bp, Diabrotica virgifera
gttctttactcacggcacctgtcaaca

SEQ ID NO: 365 - DNA, 24 bp, Diabrotica virgifera
ctaactcgtccttgtgtggcgacc

SEQ ID NO: 366 - DNA, 587 bp, Diabrotica virgifera
gttctttactcacggcacctgtcaacatttcgagcaggtcctcaagttatatccacaagcccttcgattgaaagctgatagaaaagccaaaaagcccgaggaactgattaaattagacaattggtatcagaatgaactaccgaaaaggatcaaaagtcgtggcaaagatgcccacttagtacacgaggagttggtacaatgcatgaaatggaaacagaccagggggaagttcttcccccaattatcgtatttggtaaaggttaacactcctagagctgttatggcagaaacgaagagagcctttagaaaattgcccaatcttgagttggcgatgtcagcgctctcaaatttgaaaggagtcggtaccacaatggcctcagcattactggcggctgcttgtccagacagcgccccctttatggcagatgaatgtctgatggccataccagacatcgaaggtattgattacaccaccaaggagtacctgaaattcgccaaccacatcaaatccgtcgccgagagattaaacaaggccgcagaagaaaggtcagaggctgtacgttggtcgccacacaaggacgagttag

SEQ ID NO: 367 - DNA, 882 bp, Diabrotica virgifera
  modified_base (792)..(853): n = a, c, g or t/u
ggagaaactaacatcgttgacaaccatggcggataaagaaaagaaggtcaagaagaagaagaaggaagagggcgaagcacctgctgccgctcctgcccccgccgaaaccaggtcctcctcaaagagttcctccaagaaagccaaaaggtctggttccaatgtcttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatgaagttgtcgtcaaggctttcagatcctttgacgaaaacggcaccattgacggagacagattccgtcatgccctcatgacctggggagaaaaattcaccggcaaagaatgcgacgacgccttcgatgccatggacatcgacgacaacaacaggatcgatacccaggcacttatcaccctcttaacagcagccgagaaggaagaaggtgaagaaggcgaagcagcataaacaccatcataacttataacagaaagtcaatgtaaatcttcacggctaccgtgtggttccactaagacgaaaacatcaattcggatacatctaagtgtggtgtgtttcttatataattccaatgaacacataagaaaaggtgtacttatatgtgtatnttattatgtatttgtttttaagtttatttttattcagttgctttaccatcacgcgactcanaagaaataatatattattttttgtttcat

SEQ ID NO: 368 - DNA, 28 bp, Diabrotica virgifera
ggcggataaagaaaagaaggtcaagaag

SEQ ID NO: 369 - DNA, 31 bp, Diabrotica virgifera
cacaccacacttagatgtatccgaattgatg

SEQ ID NO: 370 - DNA, 711 bp, Diabrotica virgifera
  modified_base (631): n = a, c, g or t/u
ggcggataaagaaaagaaggtcaagaagaagaagaaggaagagggcgaagcaccagctgccgctcctgcccccgccgaaaccaggtcctcctcaaagagttcctccaagaaagccaaaaggtctggttccaatgacttctccatgttttcgcaatctcaagtagctgaattcaaagaagctttccaacttatggaccacgacaaagatggcatcatctctaagagcgatttgagggccaccttcgatgctgttggtaaactcgccagtgagaaagagctcgacgagatgatcaacgaagcacccggaccaatcaacttcactcaattgttgggattgttcggtacccgtatggctgattccggcggtactgacgatgatgaagtcgtcgtcaaggctttcagatcctttgacgaaaacggcaccattgacggagacagattccgccatgccctcatgacctggggagaaaaattcaccggcaaagaatgcgacgacgctttcgatgccatggacatcgacgacaacaacaggatcgacacccaggcacttatcaccctcttaacagcagccgagaaggaagaaggtgaagaaggcgaagcagcataaacaccatcataacttacaactganagtcaatgtaaatcttcacggctaccgtgtggttccactaagacgaaaacatcaattcggatacatctaagtgtggtgtg

SEQ ID NO: 371 - DNA, 2918 bp, Diabrotica virgifera
gtagagttgaggaagatgtgcaaagtgttgaaaagtttatgtacatgaattgtagaaactaattgtttattgtgtatcattcgaattcagtttcaaaattaaaagtgtgctagtggagaaaactaaacgataacttctgtttatactgttgtttttatcgtttaacaatggctctctttcttctaggtttgttgttctgcctatctagtcggatctctgccagtggtttctacgaaatcagtaacattgacttctataattctgtttttacagattctcttgattggagattgttacaggagctatcaaaccagtataaaaacgtagtgatatctcccatcagcctaaaaatcatattatccctattatatcaaggatctaccggacagacagaaagggaattccaaacacttttaaattatcaaaataaagaatatgtcaggaacaattacagccaaattgtcgctgccctttataatgcagacagaactgaatatatgctcaacattgggacatcgatgtttgtagatgaaggtctatacgttttatctaaattcgaagaccttgcaagaaaaagcttcaaaacagacatcataaagactaactttgacaaacaggaaaaggctagtaaagatattaattcgtgggtggaacagcttactcatggtaaagtgaagaaaatagtcaatgctgatgatctgtcgcaagcactaatgataattaccaatgccatttacttcaaaggaacatggactcgtaaatttgataaaaatagatcaacgcttggaaacttctatacatctcctgataatataagatctagcagaaacttaaaattagttcaatacatgactaccactgacgaatttctttattacgaggacagatctttggatgcgaaaattgtcaggttggaatacaagggaagtgactatgccatgtatatagtcctaccgaacactttgggaggattaagcagccttatcaaaaatgtggacataaacaaaataggaactataaagttccaaatgacacaacaagttgttgaggttactattccaaagtttaagttcaattttgacatcaagttgggaaagattcttcaaaagtttggactacgcgaagcattccaaaacacggccagttttacaggcatcgtgcaaaccaacaggaccttaagaaggagtctatacgtatctgacattgttcagaaatcgggaatagaagttgatgaagaaggaagtgaaatcttctcagcatcagctgtcaacgtgggtaataaattcgccgaaaatacgatgatattcaatgcatcacatccgttcatgttctttgttgatggtcccaacggtaccatattgtttgttggacaatatgaaaatccagatgcggtggacccgtcagaggtaccgaatcgttggagtcaagaagtagaagaaaaaaatcctactgaagctgtgcaattccaaaatactcgcccaagtagaccaaataatgaaattgatcaatccaataatgtacagttccaacagcctcgtccaaatagaccaagtgttgaaagtcaacgacccgacaatgtacaattccaacagaatcgcccaaatagaccaaatactgaaaatgaacagcccagcaatgtacaaggtcttaatttgaatccaaatctggaccccgactactatcaacctccagatgtagaaatggatgagattgcatatagattcaatctgtttgatattgacttattatattccttttctgatttatccacgaacgtattaatatctcccgctagcatcaaaacgacattagcaatgattttagaaggagcagaaggaacttgtgcagaagaaataagtgaagcactgaggatacctgatattaatcaaaaaggtgtcagaagtgttcttgtagaacttctaaataatcttaatgaaagatctacgccaaatagtgtcctagaaagccataatgccatatttgtctctgaaaaacatcgactggttgataattataagaatgtcgttataaagtattacaacgcttacctgaaaagcttagatttttcaaattcagattatgctgctagggtcattaatggatggatatctgactccactcatggcgaaataaccgatgtcatctcaccacaggggatagttcctgattgttacgtggtgctgtcaaacgccctgttctttaaagcacagtggaaatatgcttttgataaaagaagtgtacgaaaatgtttccacactcctaggggatgtgtttatgttgacatgatgcacatttcacataatttcaattacaattacatcacccgtttgcgagccaatgttgtggatattccttatcaggataaattctccatgctactgatcttaccatcttcagattcaaatgtaaggagtgtgattcgggatttacctcactttagactgtcgagcattttggagagtctaaatcaatccgagattgttctagaactaccaacatttagcttcgagtattcagcagatttggttgaatttttaaaacctcttaaaatccgagaaatatttggttcccgcgctaacttaaccaaaatgatagaaggccaccatggtatgataaacaacctgttacacaagaccaaaatcacagtagacgaaaaaggaacaactgccgcagcatcctccagtgccatgataattcccctgatgcagccagtgacagttgcggctgacagaccgtttgtttttatgatctatcacagagacactaaaaatataatctttgaaggaattgtacaaaatcctttagaaaaatagtatctaacattactgataattttttatttaatgtgccgaaaactcatctaggttagatctcttcaaactgtagttacgtgtaaaaattggtctgtatttgctttt

SEQ ID NO: 372 - DNA, 26 bp, Diabrotica virgifera
ctagtcggatctctgccagtggtttc

SEQ ID NO: 373 - DNA, 30 bp, Diabrotica virgifera
ccttcttcatcaacttctattcccgatttc

SEQ ID NO: 374 - DNA, 1036 bp, Diabrotica virgifera
ctagtcggatctctgccagtggtttctacgaaatcagtaacattgacttctataattctgtttttacagattctcttgattggagattgttacaggagctatcaaaccagtataaaaacgtagtgatatctcccatcagcctaaaaatcatattatccctattatatcaaggatctaccggacagacagaaagggaattccaaacacttttaaattatcaaaataaagaatatgtcaggaacaattacagccaaattgtcgctgccctttataatgcagacagaactgaatatatgctcaacattgggacatcgatgtttgtagatgaaggtctatacgttttatctaaattcgaagaccttgcaagaaaaagcttcaaaacagacatcataaagactaactttgacaaacaggaaaaggctagtaaagatattaattcgtgggtggaacagcttactcatggtaaagtgaagaaaatagtcaatgctgatgatctgtcgctagcactaatgataattaccaatgccatttacttcaaaggaacatggactcgtaaatttgataaaaatagatcaacgcttggaaacttctatacatctcctgataatataagatctagcagaaacttaaaattagttcaatacatgactaccactgacgaatttctttattacgaggacagatctttggatgcgaaaattgtcaggttggaatacaagggaagtgactatgccatgtatatagtcctaccgaacactttgggaggattaagcagccttatcaaaaatgtggacataaacaaaataggaactataaagttccaaatgacacaacaagttgttgaggttactattccaaagtttaagttcaattttgacatcaagttgggaaagattcttcaaaagtttggactacgcgaagcattccaaaacacggccagttttacaggcatcgtgcaaaccaacaggaccttaagaaggagtctatacgtatctgacattgttcagaaatcgggaatagaagttgatgaagaagg

SEQ ID NO: 375 - DNA, 620 bp, Diabrotica virgifera
gatcggcgctcgactagtagtcggagtagggcggccaaagtaattttttgattattatagttaattggtttattttaaattaggtattaagaaaaaatcaaaatatggctattaatctacaatatgacgccataggcaaaagttttgtccaacaatattatatgcttttcgatgatccaaaccaaaggcctaatttggtaaacatgtataatgtagaacattcatttatgacctttgaaggcaagcaattacaaggatctgcaaagataatggagaaattaaattccttaggattccaaaatataaatagacaacttactgaagtagactctcaacctatgtttgatggtggtgtactgataaatgtattaggtagattgcaagttgataatgatccaccacacgcttatacacaagtttttgttttaaaaccattaaatggatcattttttgttcaacatgacatttttaggctgaacatacacaatagtgcctgattttattacatctcctctccttctttatgttgtatgttcgaatcaactgaaaatatgcaatttttaaaatctcctgtatctgtttctgcttaatatgaattcacaataataaacttattttct

SEQ ID NO: 376 - DNA, 34 bp, Diabrotica virgifera
ctattaatctacaatatgacgccataggcaaaag

SEQ ID NO: 377 - DNA, 32 bp, Diabrotica virgifera
cgaacatacaacataaagaaggagaggagatg

SEQ ID NO: 378 - DNA, 429 bp, Diabrotica virgifera
ctattaatctacaatatgacgccataggcaaaagttttgtccaacaatattatatgcttttcgatgatccaaaccaaaggcctaatttggtaaacatgtataatgtagaacattcatttatgacctttgaaggcaagcaattacaaggatctgcaaagataatggagaaattaaattccttaggattccaaaatataaatagacaacttactgaagtagactctcaacctatgtttgatggtggtgtactgataaatgtattaggtagattgcaagttgataatgatccaccacacgcttatacacaagtttttgttttaaaaccattaaatggatcattttttgttcaacatgacatttttaggctgaacatacacaatagtgcctgattttattacatctcctctccttctttatgttgtatgttcg

SEQ ID NO: 379 - DNA, 846 bp, Diabrotica virgifera
agctattttttatgtttattttttgttattataatttacaattaatttccgttgcagtattcaaagttttattaaaacatttatcgtaaatttagtgttattgttcctcaagcagaatttttatagaagaaaacatggaaactcccggcgccagcagagccccttccaaactggagcagacccagcaacaggtgaatgaagttgtgggtattatgagagtaaacgtcgagaaagttctagagagggaccagaaactttcagagctcgatagtcgagctgatgcccttcaagaaggcggcaaaaggttcgagcagcaagcacaaaagttgaaacgaaagtattggtggaaaaatataaagatgatgattattatgggggttataggcctcattattttaattatcattataatttccattgctaatgcagttaagggcgacgacaccacatcctcaagcgtaacgtcggctcctccaaaatgaaattaaatgtttacggatctttctgtatttgattatatattctgtatttgattatatatatttattgttgcattatacttaaaaataagaacaaaatattttacaattctatgtttgctttatgtcattattttaaatatattattccatagaatatggtgtttctgtttaaaaagtgaacacctatcagttgtgtaagtattgagaatttgtttttcattattatgggcataggcgcaaaatgtcgcctgtcaaaatgttcaatgtgttttaaatgtattcattttttttttcgaatcctgagaaaactaataaatatttttgaaaaatataaacgcagaatgaaagattgcattattactga

SEQ ID NO: 380 - DNA, 35 bp, Diabrotica virgifera
gtgttattgttcctcaagcagaatttttatagaag

SEQ ID NO: 381 - DNA, 26 bp, Diabrotica virgifera
cacattgaacattttgacaggcgaca

SEQ ID NO: 382 - DNA, 656 bp, Diabrotica virgifera
gtgttattgttcctcaagcagaatttttatagaagaaaacatggaaactcccggcgccagcagagccccttccaaactggagcagacccagcaacaggtgaatgaagttgtgggtattatgagagtaaacgtcgagaaagttctagagagggaccagaaactttcagagctcgatagtcgagctgatgcccttcaagaaggcggcaaaaggttcgagcagcaagcacaaaagttgaaacgaaagtattggtggaaaaatataaagatgatgattattatgggggttataggcctcattattttaattatcattataatttccattgctaatgcagttaagggcgacgacaccacatcctcaagcgtaacgtcggctcctccaaaatgaaattaaatgtttacggatctttctgtatttgattatatattctgtatttgattatatatatttattgttgcattatacttaaaaataagaacaaaatattttacaattctatgtttgctttatgtcattattttaaatatattattccatagaatatggtgtttctgtttaaaaagtgaacacctatcagttgtgtaagtattgagaatttgtttttcattattatgggcataggcgcaaaatgtcgcctgtcaaaatgttcaatgtg

SEQ ID NO: 383 - DNA, 841 bp, Diabrotica virgifera
gtgaatcatgtgtttaattaagttatagtatttattctatattaaattacgtagaatataatctctctgtgttgctttacacattaactatgtataaaaatgttacaaaggatgattggtccaaggagaatacagagaatcgttttggcaacctttatattttccgttctacatatatttggagtttttcatcatatttttgagactgatttttatacaaactttcattatccctacgatggggatatagaacatttaatacagcaattgaaggatggcaagccacctgatgttttacctattaattcctatcactttgaatataacaagaaatgtgtttcaaaatgttccagtatgaaacagttaagattggtttatataataaagagtgctccagagcattttgatcgcagaattggaatacgcaattcatgggggtatgaaaggcgattttctgatgcagaaataagaactgtctttttggttggagaacgaaattcacatgctttaaaagagtcattaaaagaagaatactcaaagtttcatgatattgtccatgccaattttacagatagttactacaacaatacttacaaaactatgatgggcttgcagtgggctgtcaggtattgtccaaattcacaatattatatgtttgttgatgatgattactacgtgtccaccaaaaatgttttaaaggatttgaaaatcccacaagtattcagaatatgtaaagaacctcttaatggagttagtccactttttaataaaaaaaaaatcttgtttataatgatttaaatgaggatgaaaaattattttcaggttatgtatttccatcccc

SEQ ID NO: 384 - DNA, 28 bp, Diabrotica virgifera
ggagaatacagagaatcgttttggcaac

SEQ ID NO: 385 - DNA, 36 bp, Diabrotica virgifera
ggactaactccattaagaggttctttacatattctg

SEQ ID NO: 386 - DNA, 636 bp, Diabrotica virgifera
ggagaatacagagaatcgttttggcaacctttatattttccgttctacatatatttggagtttttcatcatatttttgagactgatttttatacaaactttcattatccctacgatggggatatagaacatttaatacagcaattgaaggatggcaagccacctgatgttttacctattaattcctatcactttgaatataacaagaaatgtttttcaaaatgttccagtatgaaacagttaagattggtttatataataaagagtgctccagagcattttgatcgcagaattggaatacgcaattcatgggggtatgaaaggcgattttctgatgcagaaataagaactgtctttttggttggagaacgaaattcacatgctttaaaagagtcattaaaagaagaatactcaaagtttcatgatattgtccatgccaattttacagatagttactacaacaatacttacaaaactatgatgggcttgcagtgggctgtcaggtattgtccaaattcacaatattatatgtttgttgatgatgattactacgtgtccacaaaaaatgttttaaggtatttgaaacatcccacaaagtatccagaatatgtaaagaacctcttaatggagttagtcc

SEQ ID NO: 387 - DNA, 2158 bp, Diabrotica virgifera
gccattgggcgatagtctctccatggaaaattaatatttggaagaaagtatccataagtaatattctgtcaggttgaatggagctagtatctagtaatacaggctatgatggaccattgaaactataactatacaaattaggttgaatcattatcaaagattgagtaagatcttccctcatcaacatgtgtctgtagaatgaagtctcgtccggagaattattgaatacttgaagaaattgagatcttcttaagtgatacatgaactgtgggtaaagactgaagttttgaccaagtctgaatgaattggggtcgtccttattgtattctccgaatttttgacacaatctaatcagcattctgtcaacccatctaagaacatctggactatcatcagattctgccctataaacggccatcctagccattattacagcagcagcttcttgatcgaatccggcactgatatggtgtatattagcagttgcgtcagcccaatttcgagccactgttgttactctgatttttctttgaccacttgaatgctggtactgcgtaataaattgtatacaacctctaccaccttgaggtatgggagcagaatgttgatttacgacctcaaagaataaagacatggtagtacttggcgttaaagtacacattttccattgcacagtattacccattcctatttctgtgtcggaaaccaaggggctcttcacgttaagtgatacacacgaaccgatacctccttgaacttttaattctcgggaacacttcacttccaaagtaccgttaaatgccattttcagatcacttttttgatctctggtaaacacacgttggaaagtttgcttaaacaaggaagaattaaatgaatcccccattaccatgtgtcccccagtagaattacagcattgcttcatttccatcagacctgtctgatccaaagcacaagaataaatatcaacagagtgaccattagttgcggctctcattgctaacgcatcataatgtttaatacctttcttcatatattttgcattatctttctgaatatcatgatgtgatctaataggctgttttaaatcatcattaactacctgaccaggtccttgtgagcaaggtcctccaacaaatagcataactcgggcgccagtattggaatatgtacattctaacaaaccaatggcaatcgataaagctacacctgtagatcttaaataccttttaccctgatgaacaggccaaggatctttctgttgttctcctattaggtctgttagattcatatcgcatttggatacaggttgtagaaacctgcttcctggtgcaacaacagtaggttgcatttgcccaggtcttagaggctgccctggctgttgaggggcttgctgacctaaagccactttgcctattcccagcatttcttgaacctgtttagcactaagatcttttgtacctctgaacacatatgacttactacaaccttcagtgccaagttcatgaacttgaaccattttcccaaatgttattagtcctattaacgcattaggtggcaacaaactaagggacatttgcaatgagtctttcagggaacccagttcttcatcatccatgcaggtgtcaacaacatacaaaaatattggtggtaaacattgagctctagttattgtgtattcaatggtggaaaacataggcatcaattccgctggttgatgttgttctgaaatagcagcatattgaggtggaaatggatttctctggaaacaaaagttgcatacccagagttttgctcgataatctacctgacacagtgggtttaatattgctctacaagtatttctagtacataaaacagggtcatattgtattggtggaagatccagacgttcctttataggctggtacagacaagctaagggtactacgagacgggtagcttcaattctgcttgaaggccatacattccaggtaaatctaatcccatctcgatcttcattttgttgtatatactcttcatatgtgctcatttttgaagattacaagtcggaattccctaaggaaattcctcaatatatattattaggattctatcatgtaaataacactattattgagctcctaaaaattacacctaattgtttcagaatttgaac

SEQ ID NO: 388 - DNA, 33 bp, Diabrotica virgifera
gtcactctgttgatatttattcttgtgctttgg

SEQ ID NO: 389 - DNA, 35 bp, Diabrotica virgifera
ctgtcaggttgaatggagctagtatctagtaatac

SEQ ID NO: 390 - DNA, 913 bp, Diabrotica virgifera
gtcactctgttgatatttattcttgtgctttggatcagacaggtctgatggaaatgaagcaatgctgtaattctactgggggacacatggtaatgggggattcatttaattcttccttgtttaagcaaactttccaacgtgtgtttaccagagatcaaaaaagtgatctgaaaatggcatttaacggtactttggaagtgaagtgttcccgagaattaaaagttcaaggaggtatcggttcgtgtgtatcacttaacgtgaagagccccttggtttccgacacagaaataggaatgggtaatactgtgcaatggaaaatgtgtactttaacgccaagtactaccatgtctttattctttgaggtcgtaaatcaacattctgctcccatacctcaaggtggtagaggttgtatacaatttattacgcagtaccagcattcaagtggtcaaagaaaaatcagagtaacaacagtggctcgaaattgggctgacgcaactgctaatatacaccatatcagtgccggattcgatcaagaagctgctgctgtaataatggctaggatggccgtttatagggcagaatctgatgatagtccagatgttcttagatgggttgacagaatgctgattagattgtgtcaaaaattcggagaatacaataaggacgaccccaattcattcagacttggtcaaaacttcagtctttacccacagttcatgtatcacttaagaagatctcaatttcttcaagtattcaataattctccggacgagacttcattctacagacacatgttgatgagggaagatcttactcaatctttgataatgattcaacctattttgtatagttatagtttcaatggtccaccagagcctgtattactagatactagctccattcaacctgacag

SEQ ID NO: 391 - DNA, 2158 bp, Diabrotica virgifera; identical to SEQ ID NO: 387

SEQ ID NO: 392 - DNA, 28 bp, Diabrotica virgifera
ccgacttgtaatcttcaaaaatgagcac

SEQ ID NO: 393 - DNA, 33 bp, Diabrotica virgifera
gctaacgcatcataatgtttaatacctttcttc

SEQ ID NO: 394 - DNA, 1054 bp, Diabrotica virgifera
  modified_base (234): n = a, c, g or t/u
ccgacttgtaatcttcaaaaatgagcacatatgaagagtatatacaacaaaatgaagatcgagatgggattagatttacctggaatgtatggccttcaagcagaattgaagctacccgtctcgtagtacccttagcttgtctgtaccagcctataaaggaacgtctggatcttccaccaatacaatatgaccctgttttatgtactagaaatacttgtagagcaatattaaacnccactgtgtcaggtagattatcgagcaaaactctgggtatgcaacttttgtttccagagaaatccatttccacctcaatatgctgctatttcagaacaacatcaaccagcggaattgatgcctatgttttccaccattgaatacacaataactagagctcaatgtttaccaccaatatttttgtatgttgttgacacctgcatggatgatgaagaactgggttccctgaaagactcattgcaaatgtcccttagtttgttgccacctaatgcgttaataggactaatacatttgggaaaatggttcaagttcatgaatttggcactgaaggttgtagtaagtcatatgtgttcagaggtacaaaagatcttagtgctaaacaggttcaagaaatgctgggaataggcaaagtggctttaggtcagcaagcccctcaacagccagggcagcctctaagacctgggcaaatgcaacctactgttgttgcaccaggaagcaggtttctacaacctgtatccaaatgcgatatgaatctaacagacctaataggagaacaacagaaagatccttggcctgttcatcagggtaaaaggtatttaagatctacaggtgtagctttatcgattgccattggtttgttagaatgtacatattccaatactggcgcccgagttatgctatttgttggaggaccttgctcacaaggacctggtcaggtagttaatgatgatttaaaacagcctattagatcacatcatgatattcagaaagataatgcaaaatatatgaagaaaggtattaaacattatgatgcgttagc

SEQ ID NO: 395 - DNA, 910 bp, Diabrotica virgifera
  modified_base (833)..(8938): n = a, c, g or t/u
ggagagtacacgtcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgcgcaaaaacctcggggtatgaaattaggtggaaaaggtagagatgtagaatcattcgtagatcagcttanatcggaaggagaaaacgtcattactccaaaacaaaatagtatttcacagccaggaactanagctccagctatcaaaa

SEQ ID NO: 396 - DNA, 29 bp, Diabrotica virgifera
gagtacacgtcaacgtcatctcagtttgg

SEQ ID NO: 397 - DNA, 32 bp, Diabrotica virgifera
gctgatctacgaatgattctacatctctacct

SEQ ID NO: 398 - DNA, 826 bp, Diabrotica virgifera
gagtacacgtcaacgtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgcgcaaaaacctcggggtatgaaattaggtggaaaaggtagagatgtagaatcattcgtagatcagc

SEQ ID NO: 399 - DNA, 1057 bp, Diabrotica virgifera
aatagaagcaactgcttaaaaatcacacatattccttcggtgttttagtgtttgttcttaaacaatattaataaaaagttttagtttttttcaatcatgtcagcaggggatgcactagcccccggtgcgggggcggcgggtagcggcggcgacgatggcattgtgggcggtccgcgaacgccacaacaaatcgcggcccaacgacggcttcaacaaacacaggcgcaagtcgacgaagtcgtggatatcatgaaaacgaatgtagaaaaagtattggaaagagatcagaaactatcagaattagatgatagagcagatgctttacaacaaggtgcttcacaatttgaacagcaagcgggaaaactaaagagaaaattttggttacagaatttaaagatgatgataataatgggtgttattggtcttgtaatcttaataatcatagtcatgaacttcatgtaactcatgggccaaaaattcgttcgaataattggcatatacagaaaacctacaattattgaatacaacacaccaatacaaaaaatcaatattaaagtaatttaatctataggttggattgaaatagacgattaggcaagttggttgaaaaaaatataatcagttgttaaaggttcaataaatggacactggtgtttcaccaagtaattgtaattcaataataataagcctctggaaacaccattattttattatcacggtaaaatacgagtgtctagctgtcaaaaatgttaaaattgtgtatttaacgaaaaaaattaatataattaggtgaacagaacgaaaattttgtttttttaatattattgtagtaagcgaacactttgttattttttttaaggtttaattaaaagaaaaaaataaagttttaactttttttaattttataagacaattaaagaagatttaatttaattggttggttaaaaaaaagtattctttttacaatcctggaaaaaatctttgtaagtttcgataaaaaaggcttgttcaaatccaccgccctcccccccaacccgaatatttggaaaattttttt

SEQ ID NO: 400 - DNA, 23 bp, Diabrotica virgifera
caatcatgtcagcaggggatgca

SEQ ID NO: 401 - DNA, 29 bp, Diabrotica virgifera
ccaacttgcctaatcgtctatttcaatcc

SEQ ID NO: 402 - DNA, 511 bp, Diabrotica virgifera
caatcatgtcagcaggggatgcactagcccccggtgcgggggcggcgggtagcggcggcgacgatggcattgtgggcggtccgcgaacgccacaacaaatcgcggcccaacgacggcttcaacaaacacaggcgcaagtcgacgaagtcgtggatatcatgaaaacgaatgtagaaaaagtattggaaagagatcagaaactatcagaattagatgatagagcagatgctttacaacaaggtgcttcacaatttgaacagcaagcgggaaaactaaagagaaaattttggttacagaatttaaagatgatgataataatgggtgttattggtcttgtaatcttaataatcatagtcatgaacttcatgtaactcatgggccaaaaattcgttcgaataattggcatatacagaaaatctacaattattgaatacaacacaccaatacaaaaaatcaatattaaagtaatttaatctataggttggattgaaataacgattaggcaagttgg

SEQ ID NO: 403 - DNA, 882 bp, Diabrotica virgifera
  modified_base (818): n = a, c, g or t/u
gttcataacagttaatcatttattgtttgacttaacaaaaagtagacctagagtgaccaccattaaatgtaatggtcagttaacaaatgtagtgttcacaaattatgaaaaaaacctattactccttatgttgccagacaacagagtctcaaaacaagaaatattgttgttaaataatgaaataattagattattaaaattctgctatgaaactattgacaaatgcttcataactgaaaaatacctcccacaagtagaccacttcttttcgaaattttttgcaagaactcttagtagtggtttgtggagcacagctcaacaatctctggctttggaaaacctagaatcaaaagcaaaagaagtcagcccctgtcagtttgaggacttgatgcctgttgcacccactttgtgtctgcctgacgaggctcagcttcagatagatgatgccttatcagaattggaggcaagtgattatagagactggaatgaagacccattggactgtcaaagactgttcacagttctgggcagtgccctctttcattcaggatacctgttggcttcacattttattcacgaagatttgatagatgtcttttgtttctgtaaacaacaaggattgtttcatttatcaaggacagaacctataaaatcacttgttctttggaaggaggtatttccatcatcttgcaacaaattggaaaatacaaaaattgttattcctgaaggaagaaggtatttgctaatagtggaaagtggaaaagatctgttagcggtaataatggaagctgggggttgtacagaaccatctgaagaanacatgggtcctgatgcattctacgtagaagaagcgcaagctactttagcccacatccaagaatt

SEQ ID NO: 404 - DNA, 32 bp, Diabrotica virgifera
cctattactccttatgttgccagacaacagag

SEQ ID NO: 405 - DNA, 26 bp, Diabrotica virgifera
cttggatgtgggctaaagtagcttgc

SEQ ID NO: 406 - DNA, 763 bp, Diabrotica virgifera
cctattactccttatgttgccagacaacagagtctcaaaacaagaaatattgttgttaaataatgaaataattagattattaaaattctgctatgaaactattgacaaatgcttcataactgaaaaatacctcccacaagtagaccacttcttttcgaaattttttgcaagaactcttagtagtggtttgtggagcacagctcaacaatctctggctttggaaaacctagaatcaaaagcaaaagaagtcagcccctgtcagtttgaggacttgatgcctgttgcacccactttgtgtctgcctgacgaggctcagcttcagatagatgatgccttatcagaattggaggcaagtgattatagagactggaatgaagacccattggactgtcaaagactgttcacagttctgggcagtgccctctttcattcaggatacctgttggcttcacattttattcacgaagatttgatagatgtcttttgtttctgtaaacaacaaggattgtttcatttatcaaggacagaacctataaaatcacttgttctttggaaggaggtatttccatcatcttgcaacaaattggaaaatacaaaaattgttattcctgaaggaagaaggtatttgctaatagtggaaagtggaaaagatctgttagcggtaataatggaagctgggggttgtacagaaccatctgaagaagacatgggtcctgatgcattctacgtagaagaagcgcaagctatttagcccacatccaag

SEQ ID NO: 407 - DNA, 3045 bp, Diabrotica virgifera
ggttaagtacttatcggaccgcctgcctactagtttctgttgtggttgatagtttcactttaatttctttatctctgcggcgtaagatgcgcccaaaacattaagaatttaagtgttgctttaatgtttgagtttctcggttaaatattcacaattttttttctcttttcaacaaaattaaatctgaaagtacacaatgatcactgccaaaaaatatagaataactaagaagcaaatttcgcgatatgagaccgttcctgtaagaaaaatgctagatttcgtatatcttggtctatgaataacattaacataagtatttaataatagatatttcataaaaataaacatcccctgctagatttagagacttctcgcgaaattgcgaaagagaactaaaaccgaatcaaatgcaacactggcggttaaatttatactcttaacgaagttaaagaacaatcagcaactataatttataatctaatgcttactctaatctatataattttgaatatgattgttaagttgttgattttcattgttggttgctgttttcgccgttgacttgatttggccgagctttcgacgcattatgtggagtcatcagtactttcagtacttcaatttaaaaatttttatcttttgttcttcttatttttcatctaaatacaaatatatggtaaaagtaagttatatagatataaagcggtattgtttgagtaaaaacggcaactgtaggtaaaaatctgttaatgattttgaaattgtaattgcattagccgccagatgtcgccatcggtgacagttctcccgactttcgacgaaaggtaggagcgtatcgagcgccgtcaaaagttgaggttatgtttaaaatactaaccttagttgttaagttagttgcgaaccgttgcaactctcttccctcactgtttgctgcattaaaatagataaaatggcctggcgacgtacctggactcgcgaataaaggttcaccgacattgaaactgaataaaaagagagaaaactttgctggtttcttttttctacgatattaatcgatgtcttccgaaacggaggcattgcggcctattaccggcactaaataagtagagatgttatgatgtttataagtttttatgttttttaatttttttgctatgtatgttgtcgctccgagctataatacggttaggtacgtactgtaagcctattttgggcaacagcctgtggacataccaaacaaaagattgctcatgtactatatctctatcactgatatgtatttaattcgaatttatcgtgagtaatctctaaagaacaatactacgacaataaacgatggagtgattctattaaacaaaacaatactttcaggatgatccacgggctggcctacatatcgggacatacactttagatggcaaaaattagaataaatgggcggggggtaagaaattctgtgatattaaaaaatgatttcatgtctacattgaaagtgatacgaaggaaacgttagtaaagacgacgaaatcgactaatgcttttggaagtatactgcgggacactcacaatgcggactagatttaacttcgaaacacgtcgcattccgtcaagtcacatgatctactttgtccgtccccgattttgaaataacacgaaacaacagtgaccgattttcattagtgtgtttggcgacgtgaccctctagtgattgaaatataaactacgttgtgaaaagtgacaatgacagttacatcacttgtcaaaagtgactgacaatggacatttatgtcacttgtcagaagtaattgacaattcaacaaaattcaggcgaaagtttacagtaatattactttatagtccaaataattaaaatatttttgcgtttgcttgatttgagtctgctcggtatggtaaacaaaggcattagaagctgttacaacaataatgggcaacatttttcttttattataactgtctataaaaatgtttattatttacttgttgtggaactgtagtttcctggaatcagtcggagtatgatattatattttgaaaggttggcaacgttatggaaacgtatccaacatcgatgttgccaaatttccaatgtgatctgggattgccgcgcaatctgcacattcttgtcgagtttttgtactaaggggaaacgaaaaatggaaaacgaaaaaaacgatctaaagtgtctggaccgtatctccatatatgcatacttgtcgcatatcattgtgttatcaatatattttatatttatattttttgaacttttatatatttttatttgtgtcataacttctctgcccccttttttcgaaaaaaaacaggcagtgtgatcgtgccttccttacaatttcattttttatacgatcgtactaaaattggtgctactatagtatgcggtctacctgtgcatgtgtatagagcctacaaacagttttctgcctttcattattgtatacaaacccttctgagaagagattatggtgttgttctgtagaccgcaagctatagcagaaacgcgacggtagaccgcataccatagtggtaccctaaaattatctcgcccgtaccacctcgatgcggaaaaggaatctcggttgtcttggcctctcgtccgttcctgtgtccagattatattttcatacattgggaaagcgggtctaggatggctcctcggggtacacagattgttaacggaagtttttggaacggaggcgaggcgaacggtactaccgcagcttcttttttcctttgttactggatcatctgtcctgagaggtaacagaatttgtattttataattttttttatttaattatattttaggtatgttaaaactgaacgtatatgatgaaaataatgactgattgtgtattgttgaatccgattcggcagtacttaatacatttgtttgtaaaattttgagttttgctgttaatcattgtatatatgataaatatattattttacagagtccttgaggtcaattttgttagcccaggactaacctgagggagagaatatatt

SEQ ID NO: 408 - DNA, 28 bp, Diabrotica virgifera
tgagtctgctcggtatggtaaacaaagg

SEQ ID NO: 409 - DNA, 29 bp, Diabrotica virgifera
gctaacaaaattgacctcaaggactctgt

SEQ ID NO: 410 - DNA, 1125 bp, Diabrotica virgifera
tgagtctgctcggtatggtaaacaaaggcattagaagctgttacaacaataatgggcaacatttttcttttattataactgtctataaaaatgtttattatttacttgttgtggaactgtagtttcctggaatcagtcggagtatgatattatattttgaaaggttggcaacgttatggaaacgtatccaacatcgatgttgccaaatttccaatgtgatctgggattgccgcgcaatctgcacattcttgtcgagtttttgtactaaggggaaacgaaaaatgaaaacgaaaaaaacgatctaaagtgtctggaccgtgtctccatatatgcatacttgtcgcatatcattgtgttatcaatatattttatatttatattttttgaacttttatatatttttatttgtgtcataacttctctgcccctttttttcgaaaaaaaaacaaggcagtgtgatcgtgccttccttacaaatttcatttttttatacgatcgtactaaaattggtgctactatagtatgcggtctacctgtgcatgtgtatagagcctacaaacagttttctgcctttcattattgtatacaaacccttctgagaagagattatggtgttgttctgtagaccgcaagctatagcagaaacgcgacggtagaccgcataccatagtggtaccctaaaattatctcgcccgtaccacctcgatgcggaaaaggaatctcggttgtcttggcctctcgtccgttcctgtgtccagattatattttcatacattgggaaagcgggtctaggatggctcctcggggtacacagattgttaacggaagtttttggaacggaggcgaggcgaacggtactaccgcaggttcttttttcctttgttactggatcatctgtcctgagaggtaacagaatttgtattttataattttttttatttaattatattttaggtatgttaaaactgaacgtatatgatgaaaataatgactgattgtgtattgttgaatccgattcggcagtacttaatacatttgtttgtaaaattttgagttttgctgttaatcattgtatatatgataaatatattattttacagagtccttgaggtcaattttgttagc

SEQ ID NO: 411 - DNA, 1844 bp, Diabrotica virgifera
gggcggacgcgtgggtttgtctgtgcgaacttctaacctcatttttacagccttaacatacgtttgacgtctgttaatgctttttaactaatagagattgtctaaaatggcagtaatcgtttacttttgtttcttccgggatgctcaaaaaccatcaacacagtttgtataggaactaagatttttggggagactgaaggagacgttgacaggggttctcatacctgcctagagaagataatacaataatacattttatatatttattaataatatagtaataatgttgcgcgtgcgttgtctactaagcattgtggatttggtcgatcttccgatttagtttaagaaataaaaatatatgggcaacttttttttggttttgtttcctggccttggtgtgaaaccttagccacgtaattactataactatctcgggggagtaatgtgtagtgtgtgttgagtaaatgggttgttacttagtaaattcggcttcgtaaagacaaagtttctacccagactggattcgaacttattgggttcaaaggtaggctctcttaccactgagccacggaagcttgtacccgtctttgttaagattagtttatagttggcgaagaacatttcagtaagtttagctcgcgtatttcgcctctaatcttggaaaaaatatatggacgtgtttcaaatttcaaacaaattgtttattttaagaaaaacgttacgaaaacatatttagttcaaaagtactaattcctcaatatatttcattatttgaactaacattttttttatcctgattattgatttagagatgtgtacaaatcaacaatgcattagtgaatccttcactctctcttagtgtacataatttgaaacaattaattttacatccaattataggtccatgacatgtgacacattcatgtcatatatcattaagtagcaattgctcaattctatgctttcgaaattataaagtaaatcctttctgcaccagtaaaacagaattgaacaattgtgtcagcagaaacatatatttttggatagtaatgggagtcgaatgagtgtccttagataggattttgttatgattaaagtaaactttattgtaacttactgagcatggggatacgtgagcgtggggatatactcggacatttactcaaataatccttatttttgaagcttggttaggcaaatacagagacaacttaaaaacaggttaatttcaaattttctttgccacactcggtgaaatagtcggacaagtttgctagtaaaatactaagacaacttaaaaacacagatatgttaaaaaaaatcataatgcagatgtggggctaaactaagacatgtgggaatgtccgggtatttcaccacaactatgattagaaaaggcaaatattaatcggataataaaaaggtattttcagatatcttccttttaacccaggtatttccaacaaatcaattagtgcaatattaggatattgctcataaacaccacaaagcagccgattgaacaaatcttagtatctctccagatagcttatgaaattttacatcagatagagcagataactcaaaagtcaaatatttgaagatatcctagtattgttctagtgcgacgatatatataccaaaaaattataatttaaaaataaaaatcgacctgtttcgggatttttctccagagtcgcccattctcgagaaaataaatgtattccaactcaaacgttctcactgtataaaaaatgagactaaaagacataaaaaatagacagatctgatgttttcaaaatctctaatatttcgtacagttgttcacataaaacatctttttg

SEQ ID NO: 412 - DNA, 26 bp, Diabrotica virgifera
ggagactgaaggagacgttgacaggg

SEQ ID NO: 413 - DNA, 29 bp, Diabrotica virgifera
ctcacgtatccccatgctcagtaagttac

SEQ ID NO: 414 - DNA, 948 bp, Diabrotica virgifera
  modified_base (38): n = a, c, g or t/u
ggagactgaaggagacgttgacagggtttctcatactngcttagagaagataatacaataatactttttatatatttattaataatgtagtaataatgttgcgcgtgcgttgtctactaagcattgtggatttggtcgatcttccgatttagtttaagaaataaaaatatatgggcaactttttttggttttgtttcctggccttggtgtgaaaccttagccacgtaattactataactatctcgggggagtaatgtgtagtgtgtgttgagtaaatgggttgttacttagtaaattcggcttcgtaaagacaaagtttctacccagactggattcgaacttattgggttcaaaggtaggctctcttaccactgagccacggaagcttgtacccgtctttgttaagattagtttatagttggcgaagaacatttcagtaagtttagctcgcgtatttcgcctttaatcttggaaaaaatatatggacgtgtttcaaatttcaaacaaattgtttattttaagaaaaacgttacgaaaacatatttagttcaaaagtactaattcctcaatatatttcattatttgaactaacattttttttatcctgattattgatttagagatgtgtacaaatcaacaatgcattagtgaatccttcactctctcttagtgtacataatttgaaacaattaattttacatccaattataggtccatgacatgtgacacattcatgtcatatatcattaagtagcaattgctcaattttatgctttggaaattataaagtaaatcctttctgcaccagtaaaacagaattgaacaattgtgtcagcagaaacatatatttttggatagtaatgggagtcgaatgagtgtccttagataggattttgttatgattaaagtaaactttattgtaacttactgagcatggggatacgtgag

SEQ ID NO: 415 - DNA, 1700 bp, Diabrotica virgifera
  modified_base (49): n = a, c, g or t/u
attaagtattaattactgatatggtatgtccgctaaatgatccagcatntgatgctggaaagataaaataatctagtaattacaataattgttttacaaacatttaaatgcataaataaaagtaatttagaatggatattattgctacaattttattgtgtcaataatagggtacaatacgtttactttagcggggaaggttagtttagagataattcaaaaatttggtagtaagatattggatttcttataattagatcttttaaagaataaattatatacagacgtggatttaattgagtattatggtttaagtagctttatatatacaatatccataatgaatgatcattttatgattgtccagctattcaagcattttttttatcaatataacaacttgaaggtgttataatattggaatctatcgttttcgttctcatttggagtacccatctcaaaatatgatctctctagttatttaattatattaaataaaggtgagaaaacgtgaacctttacaaaatggggaggggtgggaagtagaaaatgtatgaatatgttcttcctctgtactagtcggtagaggacttttgaaattactcttttatatatatgaatcgtcgtcagtttttctctatacgttagagtttccgttccaccaattcttcggacgggtagatagacgaatgcattccacaaaactaaaggattgatttttctattttgatttcgatccaattgaatagttaagtcctattaattagatattgaccttcttttgtctgatttgcttaaagtaatttattattttctttctttcgcttgacactgtacatctattcatcttcttaatatccgatattctttgaaaacacatcttaggtcggcagtacacggacagcttgaaccagcgaccgcacggtgaactataatcctatattcgctgatatacacatgacagctcgagcacagtcacgacctcttcaaactgtcaacagcacgatgaaaatccatcgtgctgttgacagctcgagagcggttgcaaggcaacaagtgacaactcaagtagtcaacgactgctccagatatcaacgacgaccgctcgagcagtccgtgtatgtcgctcagtggtaaactgcttcaacagtccttgtacggccgcccttagagctatattatattcttaaaatctacagttaaagctgattttgattccgttttataattcctccaaatcaagagggtaggtcaaagcagagtgagttgtgttgatttttccttatgtgtgtgacgatttcacctggaggtatttccctttgtaggaagatctttgaagatctcttaatggaaaattattttctgtaatatattattcatactccatttatgtaataacaacattatagtacactaaagtatctaaaatgtttttatattaacaggtatgtgaaaaagtaacaaaatgagaattattaaaaagactagtagtacttgaagctgatgcttacaaaggccctcaatatcaacttacccattttagaaattggaattatttgagtaatactaaaactttgaggagttacttaggttctggagactttgattgaagatcctcttgagattttaatactacaaagatatttaacactgcgttaaaatttttgctattaaatattcagtatactctaatttcgaga

SEQ ID NO: 416 - DNA, 25 bp, Diabrotica virgifera
gcagtacacggacagcttgaaccag

SEQ ID NO: 417 - DNA, 40 bp, Diabrotica virgifera
gcagtgttaaatatctttgtagtattaaaatctcaagagg

SEQ ID NO: 418 - DNA, 764 bp, Diabrotica virgifera
cagtacacggacagcttgaaccagcgaccgcacggtgaactataatcctatattcgctgatatacacatgacagctcgagcacagtcacgacctcttcaaactgtcaacagcacgatgaaaatccatcgtgctgttgacagctcgagagcggttgcaaggcaacaagtgacaactcaagtagtcaacgactgctccagatatcaacgacgaccgctcgagcagtccgtgtatgtcgctcagtggtaaactgcttcaacagtccttgtacggccgcccttagagctatattatattcttaaaatctacagttaaagctgattttgattccgttttataattcctccaaatcaagagggtaggtcaaagcagagtgagttgtgttgatttttccttatgtgtgtgacgatttcacctggaggtatttccctttgtaggaagatctttgaagatctcttaatggaaaattattttctgtaatatattattcatactccatttatgtaataacaacattatagtacactaaagtatctaaaatgtttttatattaacaggtatgtgaaaaagtaacaaaatgagaattattaaaaagactagtagtacttgaagctgatgcttacaaaggccctcaatatcaacttacccattttagaaattggaattatttgagtaatactaaaactttgaggagttacttaggttctggagactttgattgaagatcctcttgagattttaatactacaaagatatttaacactgc

SEQ ID NO: 419 - DNA, 1638 bp, Diabrotica virgifera
gaatatcaacaaaatgccaagggaaaaaacaaaaaatgattaataaaactaaaatcttttttgtttttcccttttctcaaaactagaacatacaacagtataactctgggctaacaaaatgccaaggtacagaagtattcaacagcatgaggtcacttttgaatgtggtttatctaatgttgccgcaacacacttcactgtgtgttatttgttatgcaccttattcagccacataggactaagtgtggagggttcattcatcaaaattcgctttatgtgcacacatagcacataagcatacatggcaaatatgcctatccatccagttgtcagtttttacacacttcaaaagacaaatatttgggtgcatacagagtagccacgtaacaaatagcacatagcgaagtgttgtaccagcataatgtataagcttatacaaaactaggtttacctgtatctgttacagtaacgctgtaacttgcatacacatcagtatatcgagttgtctacaagtacattgtatttttttttataaagacctgtcataatattcatttaatctgtctggcagatgtttgtatgtttactgagtcaatgatttggtgatattttcaagtaaatttacgggaaaattaactatttaataaaaacagatcacatagataactgtgtggttaggggacacaagcagacaagtcaacttttcagttttatagttaaaattaatttgacgggtccactgaataatgtaagtgcctaatcacttgtttttaagaaatagaaaaaaagtgttaaaattataacaatggcaaacttatacatttaaaggttgtactcacccttaaaatgtataaactcaccattatcacaattttaaaactttttcttcaacttctcaaaaacgaacaatgggatacttacaatgttattcggcggacccattcaattaaagctaaaatcgtgagtgtgaaaaagatcactatttcatatatgaaactagacatttaacattttgaactgtcatctatttcagcagtagattattgttttaggtgtttttaaccctgcagcggacaggcgaaataaaattacattgtatttccatatggctgctgtccactggaggtttcataaataaaaatgtttctcaaaaattgagttgtctgccaccacacaattatgagttatataaccactgcattatgttttacctgtaattaacatgtctaatgttgataattttaacaaaacagcataatcaatttgtatttttaaatgtattattaaatattttgtattttgatactaaatattttgtattttgataataaattagatattaaagataaagatttatataccctattccacgaacatacgactgttgtggattatctcgacaacgaatattttactgtgtaaattataaagaatgaaagtaaattgcaaaatacattgttgtttattggaacaattagtagagccatttactttcgcacttcttatgttgcacactaaaatattcgttgtggcgataatccaagatagtcgtatattcgtggaatagcccatactaaaattataaaaaaaatgcactagaaataaacaacccaagacacgttgaatgttacaaggagc

SEQ ID NO: 420 - DNA, 31 bp, Diabrotica virgifera
ggtacagaagtattcaacagcatgaggtcac

SEQ ID NO: 421 - DNA, 23 bp, Diabrotica virgifera
gaaacctccagtggacagcagcc

SEQ ID NO: 422 - DNA, 1005 bp, Diabrotica virgifera
ggtacagaagtattcaacagcatgaggtcacttttgaatgtggtttatctaatgttgccgcaacacacttcactgtgtgttatttgttatgcaccttattcagccacataggactaagtgtggagggttcattcatcaaaattcgctttatgtgcacacatagcacataagcatacatggcaaatatgcctatccatccagttgtcagtttttacacacttcaaaagacaaatatttgggtgcatacagagtagccacgtaacaaatagcacatagcgaagtgttgtaccagcataatgtataagcttatacaaaactaggtttacctgtatctgttacagtaacgctgtaacttgcatacacatcagtatatcgagttgtctacaagtacattgtatttttttttataaagacctgtcataatattcatttaatctgtctggcagatgtttgtatgtttactgagtcaatgatttggtgatattttcaagtaaatttacgggaaaattaactatttaataaaaacagatcacatagataactgtgtggttaggggacacaagcagacaagtcaacttttcagttttatagttaaaattaatttgacgggtccactgaataatgtaagtgcctaatcacttgtttttaagaaatagaaaaaaagtgttaaaattataacaatggcaaacttatacatttaaaggttgtactcacccttaaaatgtataaactcaccattatcacaattttaaaactttttcttcaacttctcaaaaacgaacaatgggatacttacaatgttattcggcggacccattcaattaaagctaaaatcgtgagtgtgaaaaagatcactatttcatatatgaaactagacatttaacattttgaactgtcatctatttcagcagtagattattgttttaggtgtttttaaccctgcagcggacaggcgaaataaaattacattgtatttccatatggctgctgtccactggaggtttc

SEQ ID NO: 423 - DNA, 1602 bp, Diabrotica virgifera
  modified_base (1543): n = a, c, g or t/u
ctaatttaggggcttagattagtatttccttatacaataagttaaaaaatatttattttcttttagtttaattgtttcgtctgtagcactataagattattaaataatttgtgttaattactacttaaattacaaagtttattgttactctagactctagacctaacaaattatatgttatcttaaaaaaatagtgtgttcactgcatgatactccacaaataagaatagttcagacagtaactttcttttaactatcgacacataagataacatttactccttggcaagttcattggtgccctaatcaatcacaatagggaacttgcacttttttgttttattatataatattgtttagtttcctttaaaaataagatttccaaaatttcacgcctcaaaatctcataataacttagaagtacaaatttaaaatcttctatgtatttaaatcatttcaaacgatctaaaaatcgcgcgaattcttgtgacgtcatatgatcatattttgtatgtcatttctaacgtctcatttaaattacatacaattttgtttactttggagttcaaaaacacagtttttgaagagatagtaatgaattgtgtgtatttttattatggaaaataaaagtaaatactatgaaagtgttgtttaataacattctgttaaattaaaaccattgaaactcccaataaaatatttattagattaccagcggataagaaacggagattaataaagtggttacaaaggacattaaagacatgttagttcattctcaaggtcttcatggatgcgaagctaatgctaatataggtgtctgttgttttaatgtaatatgtgttgtctgcttaatagtctttttttataaatcaagtatatatagatggaaaagataaaaataatatataatatcaattgtgtgaaaaattttcttccttttgaaaatatgtggcacctggacaacataaatatatttacaatgggtaaagttatcagactgccctttaggaaaaccctcttcggtcattttaaaaaattgtcttaacaaaaacactcaaatattatgaaatatatagttcacagcaactatctaaagatttataaactgaaatagaccataaaatgattacaataatcataaacaatattaaacaaaaacttaatgaattaacgacgctgaatttaaacattataataatacgacgtcgcgaccaatcaggtcgccttttgggctggccgctataatgtgaattgtctctcgatattaatcatctttaggggccaaatgaaagaaaaaaacaacttttttcctttggtatatattttaaattatggtctgttgggatttatagcattttgtcgaatttaaaattctatgtaagttccctattcatttaggattgatgagagattgtaaagatcaattatgtcaacaaagctaaaatcattgtgaaaaagtggttatttacatagctacataaatagctttttcttacatttgtcaaagaatagagttgaaagggacactacatagtcttanaactaattatttcaagaagtattattcattgtcttgagtatttcaaactgaaacatcgt

SEQ ID NO: 424 - DNA, 23 bp, Diabrotica virgifera
ctccttggcaagttcattggtgc

SEQ ID NO: 425 - DNA, 26 bp, Diabrotica virgifera
ctccgtttcttatccgctggtaatct

SEQ ID NO: 426 - DNA, 453 bp, Diabrotica virgifera
ctccttggcaagttcattggtgccctaatcaatcacaatagggaacttgcacttttttgttttattatataatattgtttagtttcctttaaaaataagatttccaaaatttcacgcctcaaaatctcataataacttagaagtacaaatttaaaatcttctatgtatttaaatcatttcaaacgatctaaaaatcgcgcgaattcttgtgacgtcatatgatcatattttgtatgtcatttctaacgtctcatttaaattacatacaattttgtttactttggagttcaaaaacacagtttttgaagagatagtaatgaattgtgtgtatttttattatggaaaataaaagtaaatactatgaaagtgttgtttaataacattctgttaaattaaaaccattgaaactcccaataaaatatttattagattaccagcggataagaaacggag

SEQ ID NO: 427 - DNA, 1529 bp, Diabrotica virgifera
  modified_base (874): n = a, c, g or t/u
gagatatttgtagtatagttttgctttgaagattcattataggtttttaattatgattaatgaaatgatggaactatcgaacaattagaatctgtatatctttaggcaaatctgtaaataatcattgtagttattcttggaactagtttgcaactaagaaatataatttaagactttttgaacacagtcaaaagaccatgactatcacagatgtggattagtaccactttaaatttgttaataaaacatagaatttatagaatagtttccccgttttataccgcatatgcgactttaggattatagcaggctgtcatctctagggctacggtatacaagaaagataacagggccagtgctacgcttcaaccgcctattattacccctggttttagccaaggaactcattttattcaggctgagtcgacctggggcctatttaaaaatgtctagttgttcttgccggcgctgggtctcgaacccaggtctaccagcaagcgagtcagacatcctaccgctgaactacgccggcccatacgtagagtttataattatcttatatataataaaggaatttgattaaaaaaggtaaaaatacattgtattgggttgcttaggcctaaatacatatctcttcctattagtaagttacaaaatggtgagattcgatcatttttgtgggatatgtagttgatgaattaagtagtaagtagtagttgaatacacgttacattttctcaacattgattaatacatttatttttttccaaaataagaaaaatttagctactaaaaaaatatatgctaaatattgtttatcatcagctaaaagttaggagatctgttaaatcctataaaatatgaaaacaatganaatgtgttgtttcggtaagtacatagtttgcagacaactggacgatacaagggatctaataacttttagcaattgataaattgaacgaaaaaatcacaatgtttaatcaaaagctcaaacacaagaacacaaagtttttatgatgttaaataaatgaagactttctaccgttcacacgaaaggcgcttatcctgatctggttacattttcttaagataaaaccgtgggtacataatatacacaatcaaacttatatggaatcaccatgtatttcaaaccaatatttatttcttttgaaaaaaacttgttaccaggcgcggatacaggggagggtcaaggggtctatagacccccctattgtatttagtctataagaatttttttattatttattatttttttctgtcaactctaaactttaagccaccagtagaacactaaaattaaacgacaaccacttccaaagaattattgaaagaagcaataaaatctaataaaaccgagccttttctgaaaaataaattgaagccgcatttgtttgggtaccgatggagccgtaaacaactgaaatatttttctcaattcaaagaataacggaaatgatatcttaaaatgcaaatacttttcgtgaggtaaggtttatacccggtgtaat

SEQ ID NO: 428 - DNA, 30 bp, Diabrotica virgifera
gtcaaaagaccatgactatcacagatgtgg

SEQ ID NO: 429 - DNA, 31 bp, Diabrotica virgifera
cgtccagttgtctgcaaactatgtacttacc

SEQ ID NO: 430 - DNA, 731 bp, Diabrotica virgifera
gtcaaaagaccatgactatcacagatgtggattagtaccacttcaaatttgttaataaaacatagaatttatagaatagtttccccgttttataccgcatatgcgactttaggattatagcaggctgtcatctctagggctacggtatacaagaaagataacagggccagtgctacgcttcaaccgcctattattacccctggttttagccaaggaactcattttattcaggctgagtcgacctggggcctatttaaaaatgtctagttgttcttgccggcgctgggtctcgaacccaggtctaccagcaagcgagtcagacatcctaccgctgaactacgccggcccatacgtagagtttataattatcttatatataataaaggaatttgattaaaaaaggtaaaaatacattgtattgggttgcttaggcctaaatacatatctcttcctattagtaagttacaaaatggtgagattcgatcatttttgtgggatatgtagttgatgaattaagtagtaagtagtagttgaatacacgttacattttctcaacattgattaatacatttatttttttccaaaataagaaaaatttagctactaaaaaaatatatgctaaatattgtttatcatcagctaaaagttaggagatctgttaaatcctataaaatatgaaaacaatgaaatgtgttgtttcggtaagtacatagtttgcagacaactggacg

SEQ ID NO: 431 - DNA, 1208 bp, Diabrotica virgifera
atattatttgttctgtgaagcagctttgttaggaaaaatcaaaatgttttcagctacgtttaaactgttatttttgataacagtaatattggtatccctttcgccatccagtgcagacaattataacaaatgtcctgaaaccagccatatacgatccctaatttaccagaatacattgaaggggagagttatacatgtacgcattccaggcacaggtttctttgaagctccaatcacttgtcttcaggttaccgatataaatgaaagtttcagtacaccagttgtagaagaaggtggatatggaagggagtacgtagttttacgtattgacccagttgaatcaggagaacagttacaatacgatgttcagatttatattgacgaagctgttacagcctatcctcaataaatgttcggtataaatgtttaagaaattcgagtagcccctttaaagataagcagttgctggtattttaacagcattactgattgtaagttaatcatttcagaccttcacgtaaactatgttgttacaaaaacgcatattaggacaataatccaaattattagacaataaatattaggcaagagaaattaaacgagtttctagttttaagtacaaacaagtgaagttcatcagcaaaacagaattcagaattattctacgtattatattaaaagcactatttggttaaaagttatcatttttgggggtaaaagaatctattaatttgtcttgagtaaaggtagtatttgtttaaatttgccgaccgatgataggtagattgggccaagtacagtgggtgatcatattattagagccacctaatatgttcagtgttttggaggaatgtttacaatgttttgtaatttaatgtttacaatgtttagaatgtttacattaaattacaaaaacgcatattaggacaataatccaaattattagacaataaatattaggcaagagaaattaaacgagtttctagttttaagtacaaacaagtgaagttcatcagcaaaacagaattcagaattattctacgtattatattaaaagcactatttggttaaaagttatcatttttgggggtaaaagaatctattaatttgtcttgagtaaaggtagtatttgtttaaatttgccgaccgatgataggtagattgggccaagtacagtgggtgatcatattattagagccacctaatat

SEQ ID NO: 432 - DNA, 23 bp, Diabrotica virgifera
cctttcgccatccagtgcagaca

SEQ ID NO: 433 - DNA, 30 bp, Diabrotica virgifera
ctccaaaacactgaacatattaggtggctc

SEQ ID NO: 434 - DNA, 752 bp, Diabrotica virgifera
cctttcgccatccagtgcagacaattataacaaatgtcctgaaaccagccatatacgatccctaatttaccagaatacattgaaggggagagttatacatgtacgcattccaggcacaggtttctttgaagctccaatcacttgtcttcaggttaccgatataaatgaaagtttcagtacaccagttgtagaagaaggtggatatggaagggagtacgtagttttacgtattgacccagttgaatcaggagaacagttacaatacgatgttcagatttatattgacgaagctgttacagcctatcctcaataaatgttcggtataaatgtttaagaaattcgagtagcccctttaaagataagcagttgctggtattttaacagcattactgattgtaagctaatcatttcagaccttcacgtaaactatgttgttacaaaaacgcatattaggacaataatccaaattattagacaataaatattaggcaagagaaattaaacgagtttctagttttaagtacaaacaagtgaagttcatcagcaaaacagaattcagaattattctacgtattatattaaaagcactatttggttaaaagttatcatttttgggggtaaaagaatctattaatttgtcttgagtaaaggtagtatttgtttaaatttgccgaccgatgataggtagattgggccaagtacagtgggtgatcatattattagagccacctaatatgttcagtgttttggag

SEQ ID NO: 435 - DNA, 1290 bp, Diabrotica virgifera
gttccagaggagtgcagaatgttttattagtgaagcctttaaacaggtttttgtgtgaataaaaccggtgtatattattgtgaataaatgtgtcaaatataggatatatacctgaaacagattaactgcacttgtttaataaaaggcactactacttactaacacaagatgtccgtattgggaatggtatcagccgtagcgggctttgtcaaagtccgctacttggttgataaagctctaatcgacaatatggtgtttagagcccactatagagtcacgtcggccatattgtttttatgctgtatcatcgttactgcgaataatctaattggtgaccccattcagtgcatcaacgacaggggtgttccaggtcatgtaataaatacgttttgctggataacgcatacttttacgttaccacatgaacaaggaaaacgcgtcgggacagaagttgctcatcctggtcttggtaacgaaaatcaggataagagataccacagctactaccaatgggttccattcgttttattcttccagggcgtcctcttttacatccctcattggttgtggaaaaattgggaacaaggaaaaattcgtatgatcaccgaaggtatgagaggatcgatggtcggagttggggaaaaggcagagagagaacatagacagaatagactcgtacaatatcttatcgaaacgatgcacatgcacacttcctatgcattcggatactttatttgtgaagctctaaacttcgttaatgtgatggtaaacatattcatgactgacaaattcctcggtggagcgttcctaacctacggcactgacgtagtttccttttcgaacatgaatcaagaaaatcgcacggatcccatggtagccatctttccaagggtaacaaaatgtacattccacaaattcggtccttcaggatcaattcagaagcatgacgccctctgcgtgttagccttgaacattctcaacgagaagatttacattttcctatggttctggtttattattttagctatactgtccggtttggctattgtgtattcggcagctgttgtattactacctagtacaagagaaacgattttgaagaggagattcagattcaaggtacccaatgctgttgagactattgtcagaaaaacacaggttggtgatttccttttgattcacttactgggacaaaacacaaaccaattggtatttggcgaaattttggacgaattcgtaagaagactgaatttcggtagtaacagcaacttaccgtctgctcccagcacg

SEQ ID NO: 436 - DNA, 29 bp, Diabrotica virgifera
cacaagatgtccgtattgggaatggtatc

SEQ ID NO: 437 - DNA, 31 bp, Diabrotica virgifera
gtaagtgaatcaaaaggaaatcaccaacctg

SEQ ID NO: 438 - DNA, 1023 bp, Diabrotica virgifera
cacaagatgtccgtattgggaatggtatcagccgtagcgggctttgtcaaagtccgctacttggttgataaagctctaatcgacaatatggtgtttagagcccactatagagtcacgtcggccatattgtttttatgctgtatcatcgttactgcgaataatctaattggtgaccccattcagtgcatcaacgacaggggtgttccaggtcatgtaataaatacgttttgctggataacgcatacttttacgttaccacatgaacaaggaaaacgcgtcgggacagaagttgctcatcctggtcttggtaacgaaaatcaggataagagataccacagctactaccaatgggttccattcgttttattcttccagggcgtcctcttttacatccctcattggttgtggaaaaattgggaacaaggaaaaattcgtatgatcaccgaaggtatgagaggatcgatggtcggagttggggaaaaggcagagagagaacatagacagaatagactcgtacaatatcttatcgaaacgatgcacatgcacacttcctatgcattcggatactttatttgtgaagctctaaacttcgttaatgtgattgtaaacatattcatgactgacaaattcctcggtggagcgttcctaacctacggcactgacgtagtttccttttcgaacatgaatcaagaaaatcgcacggatcccatggtagccatctttccaagggtaacaaaatgtacattccacaaattcggtccttcaggatcaattcagaagcatgacgccctctgcgtgttagccttgaacattctcaacgagaagatttacattttcctatggttctggtttattattttagctatactgtccggtttggctattgtgtattcggcagctgttgtattactacctagtacaagagaaacgatttgaagaggagattcagattcaaggtacccaatgctgttgagactattgtcagaaaaacacaggttggtgatttccttttgattcacttac

SEQ ID NO: 439 - DNA, 845 bp, Diabrotica virgifera
caaactctttacaggttgagtatagcagtttaacagtatcttcaacaaggtctcgagttacatatgtttcgtgttaaagtgcagtgtaagtgaagttacaactttgcggtgcatcgcctaaaagtcatggctcttgtagccagctcctggcgagagacatccttaggtaacccggtgagcctgaactctttgcccaacggtttgaatcctttacctcagactagtactttaactcctttacccaccaacattaatcctattaatcttgaaacatccgatccttcgctgatcaatcgacaaacgccgtcacaaaactcacaaaatagtaataacagtgtagataagaaccagaacattgagtgtgttgtgtgtggggacaaaagttctggtaaacactacggacaattcacatgcgaaggatgcaaatcattttttaaaaggagtgttagaagaaatttaacgtactcatgtcgagggagccgaaattgtccgatagatcaacatcatagaaaccagtgccaatattgtcgtttaaaaaaatgtatgaaaatgggcatgcggagagaagctgtgcagcgtggcagagtaccaccgtcgcagccttcgcttccaggtttaccaaatcagttccttaactcaacagactcgatgaatacatctctaagcaaccacacgtacctcagtagttacatatcactattattaagagcagagccgtaccctacgagtcgatatggtcaatgtctgcaaagtaataacattatgggcattgacaatatatgcgagttagcagcgcggctgctattctcagcagtagaatgggcaaggaatataccgttctttcc

SEQ ID NO: 440 - DNA, 25 bp, Diabrotica virgifera
gctcctggcgagagacatccttagg

SEQ ID NO: 441 - DNA, 28 bp, Diabrotica virgifera
gcagacattgaccatatcgactcgtagg

SEQ ID NO: 442 - DNA, 606 bp, Diabrotica virgifera
gctcctggcgagagacatccttaggtaacccggtgagcctgaactctttgcccaacggtttgaatcctttacctcagactagtactttaactcctttacccaccaacattaatcctattaatcttgaaacatccgatccttcgctgatcaatcgacaaacgccgtcacaaaactcacaaaatagtaataacagtgtagataagaaccagaacattgagtgtgttgtgtgtggggacaaaagttctggtaaacactacggacaattcacatgcgaaggatgcaaatcattttttaaaaggagtgttagaagaaatttaacgtactcatgtcgagggagccgaaattgtccgatagatcaacatcatagaaaccagtgccaatattgtcgtttaaaaaaatgtatgaaaatgggcatgcggagagaagctgtgcagcgtggcagagtaccaccgtcgcagccttcgcttccaggtttaccaaatcagttccttaactcaacagactcgatgaatacatctctaagcaaccatacgtacctcagtagttacatatcactattattaagagcagagccgtaccctacgagtcgatatggtcaatgtctgc

SEQ ID NO: 443 - DNA, 932 bp, Diabrotica virgifera
  modified_base (650)..(836): n = a, c, g or t/u
aaagagtatgtggtgtttaatgttatttcgagtgggattatctatcttatttttctttcatacaacattagctcttcctgatgaatgtagttctatttcgcctgtaagaagttgtttactgaggacaaactacatagatatacggctgtggagatattacgctggctatttttgctacatttatacaaatgaagccaggttggatatcaaatataattccactagttacaacataacatgtggcggtgaaaacgcaacgattcccgtagcaagggtggaggagaacataatagctagttatgattatacagataaagaagatgtccagcatatcagaaaatcgtttaagactgacgaggtttttaaaaattatatatcttgttgccaaggagctataaggtgttgcaatgatcacatggacgaggaaaatgttattccaacgcaatcacaatgtcctgtaatatgggatgcctggtcttgttttccacaaactaaagttaatactacagccaagctaccatgtagtagccaagcataccaatctcccgatgaagtctgtactttagaaagcgaaaaacactgcatctggaacggaacaaatcaaaaagcacaatggatccaacaaactgactacacaacgtgtgccatangcgccggtttacgaacgaagatacaacttccatattatatttctggggagtctgtatcggcttttgtataccggcaatatctatatttttctttttcgaaaaacttcgaaagaccatcagagttattctgcataggaaccttttgatagcccattgtgngtcaggaatgtcttgacaattatgtgncaagaactagtgctgctagacgctttaaaagcttcggctctaagtcatcgtacgatggacaacaatggagtcccatggtcggatattggcttttat

SEQ ID NO: 444 - DNA, 31 bp, Diabrotica virgifera
gctcttcctgatgaatgtagttctatttcgc

SEQ ID NO: 445 - DNA, 26 bp, Diabrotica virgifera
cgtacgatgacttagagccgaagctt

SEQ ID NO: 446 - DNA, 817 bp, Diabrotica virgifera
  modified_base (627): n = a, c, g or t/u
gctcttcctgatgaatgtagttctatttcgcctgtaagaagttgtttactgaggacaaactacatagatatacggctgtggagatattacgctggctatttttgctacatttatacaaatgaagccaggttggatatcaaatataattccactagttacaacataacatgtggcggtgaaaacgcaacgattcccgtagcaagggtggaggagaacataatagctagttatgattatacagataaagaagatgtccagcatatcagaaaatcgtttaagactgacgaggtttttaaaaattatatatcttgttgccaaggagctataaggtgttgcaatgatcacatggacgaggaaaatgttattccaacgcaatcacaatgtcctgtaatatgggatgcctggtcttgttttccacaaactaaagttaatactacagccaagctaccatgtagtagccaagcataccaatctcccgatgaagtctgtactttagaaagcgaaaaacactgcatctggaacggaacaaatcaaaaagcacaatggatccaacaaactgactacacaacgtgtgccatagcgccggtttacgaacgaagatacaacttccatattatatttctgggnagtctgtatcggcttttgtataccggcaatatctatatttttctttttcgaaaaacttcgaaagaccatcagagttattctgcataggaaccttttgatagccattgtggtcaggaatgtcttgacaattatgtgcaaagaactagtgctgctagacgctttaaaagcttcggctctaagtcatcgtacg

SEQ ID NO: 447 - DNA, 880 bp, Diabrotica virgifera
  modified_base (737)..(851): n = a, c, g or t/u
ccaaattcagatttggttggaggagataattttgaagcctctaaatatttaaggatacttcaacaggcaatgaatgaagatgaagaaggattagtagaaagacatagaggaatctatggattgaaagtagtgaaaaaatcaggtgaaactggatattgggtgatcaatactaaggtaggcaaaggacagatagtatttaatggaaaagacaagccagatgttactttcattgttaaggaagaggatgttttagaattattgtctggcaaaattccaccacagaaggcatttttccaaggcaaagtaaaaattcaagggaatatgggtgtagccatgcgattaatagaattacagaaaacagccgctgccaaaattgaggtacttagggctaagttataaattacgtttataggtaattttctttatctttctgtattgtgtacactaaggttttgttttatctttttgggagtatatattatataagtgacaaaacatactttcttgttttacacatcacttcctgtaaaaatattgtacacgctgtacaatgagtcctttatgtaaacaaatatgtaagtataaatacttgctctgttatctcctttttattacatatttttgttgataacttcagaatctattgaccttttgtgaaatactttcaatattttgttaacagttgaagaccagtgtaatttttcctgagatactaaattcaaatatttttgtttcanacaagtttgttccgtaaataaactagacatgtatatcattgtatattattaataatatgaaaccttgatgtctgtaggtaaatggtcttaatgatttaatggtttttcataatncatagtccnaagtcacaaaatagcatata

SEQ ID NO: 448 - DNA, 30 bp, Diabrotica virgifera
ggcaatgaatgaagatgaagaaggattagt

SEQ ID NO: 449 - DNA, 34 bp, Diabrotica virgifera
ccattaaatcattaagaccatttacctacagaca

SEQ ID NO: 450 - DNA, 774 bp, Diabrotica virgifera
ggcaatgaatgaagatgaagaaggattagtagaaagacatagaggaatctatggattgaaagtagtgaaaaaatcaggtgaaactggatattgggtgatcaatactaaggtaggcaatggacagatagtgtttaatggaaaagacaagccagatgttactttcattgttaaggaagaggatgttttagaattattgtctggcaaaattccaccacagaaggcatttttccaaggcaaagtaaaaattcaagggaatatgggtgtagccatgcgattaatagaattacagaaaacagccgctgccaaaattgaggtacttagggctaagttataaattacgtttataggtaattttctttatctttctgtattgtgtacactaaggttttgttttatctttttgggagtatatattatataagtgacaaaacatactttcttgttttacacatcacttcctgtaaaaatattgtacacgctgtacaatgagtcctttatgtaaacaaatatgtaagtataaatacttgctctgttatctcctttttattacatatttttgttgataacttcggaatctattgaccttttgtgaaatactttcaatattttgttaacagttgaagaccagtgtaatttttcctgagatactaaattcaaatatttttgtttcaaacaagtttgttccgtaaataaactagacatgtatatcattgtatattattaataatatgcaaccttgatgtctgtaggtaaatggtcttaatgatttaatgg

SEQ ID NO: 451 - DNA, 576 bp, Diabrotica virgifera
aaattatcggcatatattatgcaggataaccaactacatgctaatctaagagtggatgaagctatggctgtcgcagctgcacttaaaattggcgccaaaagtccaaaagatcgagaagatatcattaacgaaatcctagacacacttggactgctggatcataagaaaacaatgacaagcgggttgtcggggggccaaaagaagagattgtcaatcgccttagaattagttagtaatcctccagttatgtttttcgatgaacctactagtggattggattcttcatcatgttttcaatgtatatcactgttgaaaaccttagctaaaggtggaagaactataatatgtactattcaccaaccttcagctagactgtttgaaatgttcgaccaactttatacactcgctgatggtcaatgtgtttaccaaggttctacgacattcttggtgccctttttggcaagtctgcagttacagtgtccttcataccacaatccagcctcctatattatagaagtagcatgtggggaatatggagatcacacgagaacgttagttaacgctatagaaaatggt

SEQ ID NO: 452 - DNA, 34 bp, Diabrotica virgifera
ggataaccaactacatgctaatctaagagtggat

SEQ ID NO: 453 - DNA, 26 bp, Diabrotica virgifera
ggaggctggattgtggtatgaaggac

SEQ ID NO: 454 - DNA, 482 bp, Diabrotica virgifera
ggataaccaactacatgctaatctaagagtggatgaagctatggctgtcgcagctgcacttaaaattggcgccaaaagtccaaaaagatcgagaagatatcattaacgaaatcctagacacacttggactgctggatcataagaaaacaatgacaagcgggttgtcggggggccaaaagaagagattgtcaatcgccttagaattagttagtaatcctccagttatgtttttcgatgaacctactagtggattggattcttcatcatgttttcaatgtatatcactgttgaaaaccttagctaaaggtggaagaactataatatgtactattcaccaaccttcagctagactgtttgaaatgttcgaccaactttatacactcgctgatggtcaatgtgtttaccaaggttctacgacattcttggtgccctttttggcaagtctgcagttacagtgtccttcataccacaatccagcctcc

SEQ ID NO: 455 - DNA, 759 bp, Diabrotica virgifera
cccacgcgtccggtactacatgtatggtactgctttagttgtgttttgacagattcgttcaataatatcatttcttttatttatttatatattaatctttgaagatgttgtctggtggctatatattggaattgtgcaatgttttttattctggacaggtaaaaaagcgctctgttcttcaaagaatggttggcaacattaaaactgcagtaatcttaaaagatgtgtccatgttggtacattctggtgaggtcctagcagtgctgggatcaaaaggtagtgggaagaaagccttacttgatgttatttcaagacgagcacaaggccctataagaggacagatatatctgaacaaccatccagtcagtatgggtttattccagcagaaatgtgcatatgttacacataaatgtgattttataccaggactaaatgttgaacagacgttgtattatactccgactaagttcactggctatttaaaaatgtctaaagtaaagcaagtgatagcagatttagcattgtcacaagtcgctaaaaaatgcgttgaagatttgacaaaaagtgaatacagaagactgatgattggtgtccaactaatcaaaaacccagtggtactattactagacgaacccacctgggatctggacccactaaacacatacctaataatttcaatactttcaaatgcagctaaaaagtatggaactgctataatcttgacgatggagaagcctagatctgatgttttcccgttct

SEQ ID NO: 456 - DNA, 32 bp, Diabrotica virgifera
ggtactgctttagttgtgttttgacagattcg

SEQ ID NO: 457 - DNA, 31 bp, Diabrotica virgifera
gcttctccatcgtcaagattatagcagttcc

SEQ ID NO: 458 - DNA, 710 bp, Diabrotica virgifera
ggtactgctttagttgtgttttgacagattcgttcaataatatcatttcttttatttatttatatattaatctttgaagatgttgtctggtggctatatattggaattgtgcaatgttttttattctggacaggtagaaaagcgctctgttcttcaaagaatggttggcaacattaaaactgcagtaatcttaaaagatgtgtccatgttggtacattctggtgaggtcctagcagtgctgggatcaaaaggtagtgggaagaaagccttacttgatgttatttcaagacgagcacaaggccctataagaggacagatatatctgaacaaccatccagtcagtatgtgtttattccagcagaaatgtgcatatgttacacataaatgtgattttataccaggactaaatgttgaacagacgttgtattatactccgactaagttcactggctatttaaaaatgtctaaagtaaagcaagtgatagcagatttagcattgtcacaagtcgctaaaaaatgcgttgaagatttgacaaaaagtgaatacagaagactgatgattggtgtccaactaatcaaaaacccagtggtactattactagacgaacccacctgggatctggacccactaaacacatacctaataatttcaatactttcaaatgcagctaaaaagtatggaactgctataatcttgacgatggagaagc

SEQ ID NO: 459 - DNA, 837 bp, Diabrotica virgifera
cttaaaagggagagatctcttcgaggaaaaaaaagtaggtctctattccgacgaaacgaaagcagtgcccgcagcaatcattatgcagtttttgttattgtataagaggaatctgctgataataaagagatgttacggtccatcgctgaacagagtattggcccacattgttattggtctgatctttggctatttgtatagaaacgttggaagtgccgcggatacagttttagcaaattatgtatatttgtatggtactcttttactcacagtatatactggtaaaatgcccgtaactttatcatttcctctagaaatgaagatactctctagagagcattttaaccgttggtataagctaactccatatttattgtctgtgatattagttgaaattcctttccaagttatatgtacatggatgtacatagcagtatcttattcgttaacgaaccagccattagactttaggttattcttgtttgtcatttttgtaacagcgtgttctctctgtggccaatccatgggatattttataggagccacaacaccagtaaaggtagctgtattcatcgccccagtgttagcctgcttcttatcagtcttcggtttttgcatcagagcaatagacacctctaccatgttcaaaccgatcttcttcatcagttactttagagcagcattccaaagcgtcgtttatagtatttacggctttaaccgagagatattggtttgcccaatagaggaggaatactgtcattataaagatcctcacaagttcctctcggaaatgaaattttagatgtagattttagttcaaattttatattgattggt

SEQ ID NO: 460 - DNA, 28 bp, Diabrotica virgifera
ggtctctattccgacgaaacgaaagcag

SEQ ID NO: 461 - DNA, 31 bp, Diabrotica virgifera
cgtaaatactataaacgacgctttggaatgc

SEQ ID NO: 462 - DNA, 673 bp, Diabrotica virgifera
ggtctctattccgacgaaacgaaagcagtgcccgcagcaatcattatgcagtttttgttattgtataagaggaatctgctgataataaagagatgttacggtccatcgctgaacagagtattggcccacattgttattggtctgatctttggctatttgtatagaaacgttggaagtgccgcggatacagttttagcaaattatgtatatttgtatggtactcttttactcacagtatatactggtaaaatgcccgtaactttatcatttcctctagaaatgaagatactctctagagagcattttaaccgttggtataagctaactccatatttattgtctgtgatattagttgaaattcctttccaagttatatgtacatggatgtacatagcagtatcttattggttaacgaaccagccattagactttaggttattcttgtttgtcatttttgtaacagcgtgttctctctgtggccaatccatgggatattttataggagccacaacaccagtaaaggtagctgtattcatcgccccagtgttagcctgcttcttatcagtcttcggtttttgcatcagagcaatagacacctctaccatgttcaaaccgatcttcttcatcagttactttagagcagcattccaaagcgtcgtttatagtatttacg

SEQ ID NO: 463 - DNA, 660 bp, Diabrotica virgifera
ttcgtccgaaatcatctagtgtggttcgactacgcgtttatactaagtaatctgaagtggctggacattcacggtaactttattgaacatctcgctaattattacaagattcaagacgtaatcagagtcaaaactttagatgctagtcataatcgtattaccgaaatttctcctatgtctattcctaatagtatagaacttttatttattaataacaattttatcaaatcggtgcaaccaaatactttcctcgataaatcaaacttagctcgtgtcgatatgtatgctaacgacatgacaaatttagatttaaattctctgagaatcgctccagttcattcgaaccgttccttaccagaaatatatcttggtggcaatacctttcattgtgactgtactatggagtggctacagcttatcaacaacatgtcagcatccaggcagtatcctcgtgtaatggacatggacaacattgtatgcaaaatgacacattctagaggtatgacacatatgccattaaatcaggcaaaacaaagtgactttctttgtaactacgaaacacattggtttgctctttgccattgctgggattttgatgcatgtgattgtgaaatgacttgtcctaataattggacttgttaccacgatcagacgtggaat

SEQ ID NO: 464 - DNA, 31 bp, Diabrotica virgifera
ctaagtaatctgaagtggctggacattcacg

SEQ ID NO: 465 - DNA, 26 bp, Diabrotica virgifera
gcaatggcaaagagcaaaccaatgtg

SEQ ID NO: 466 - DNA, 543 bp, Diabrotica virgifera
ctaagtaatctgaagtggctggacattcacggtaactttattgaacatctcgctaattattacaagattcaagacgaaatcagagtcaaaactttagatgctagtcataatcgtattaccgaaatttctcctatgtctattcctaatagtatagaacttttatttattaataacaattttatcaaatcggtgcaaccaaatactttcctcgataaatcaaacttagctcgtgtcgatatgtatgctaacgacatgacaaatttagatttaaattctctgagaatcgctccagttcattcgaaccgttccttaccagaaatatatcttggtggcaatacctttcattgtgactgtactatggagtggctacagcttatcaacaacatgtcagcatccaggcagtatcctcgtgtaatggacatggacaacattgtatgcaaaatgacacattctagaggtatgacacatatgccattaaatcaggcaaaacaaagtgactttctttgtaactacgaaacacattggtttgctctttgccattgc

SEQ ID NO: 467 - DNA, 894 bp, Diabrotica virgifera
  modified_base (745)..(784): n = a, c, g or t/u
cgtaaataagattcttgtgttattatttcttcctttttgcttcggcaaaagtgtagaagtgacttttaaagatgtcacgttcaaaggctttagtgtttttacagaaaagttcaagaaaaagatcccatctggaaacaaactagcagattttttgcccccgaaaactgtttatgatgccattgaaatgaaggaacaacatatacctgtacttgccaaaggctcgttggcagatctagaccagttggacgaattggttattgagtactgtggtgttgaagaagttgaatctggagctatcagtaatgtacctaacctaagaaaactgtcacttaaaggtaatgccatcaagtcgattgcaaaggacgtattttcccatttaggaatatctacactagaccttagcctcaatcagatatcaacaatccatccacaggcctttgacaacatgccggatctcttaaacattcaacttgctgacaattttataacgcaatggaatccagaatggctcaagaatacaccgctattgaccaggatctcgcttcagaataattccatagaaaagctaccagcccatgcatttaaaaacatggtaggagataaaaagtatggaaaaatagacctcactattaatctggtatttagtcataataaaataagtgagatagatcctgaagctttcgcggatctcagcagaattaacaacttgtggttagataacaatgttctagaaagtttcgatganaaccttttatcgggaataaaagttaatgatttgagactncacaaaaataatatcaaatgtttagatggtaatctagataaaatactaaaagcagaaacgaacacatagattcgaatccgtcgactgtaattgcttgagaagatcaagga

SEQ ID NO: 468 - DNA, 26 bp, Diabrotica virgifera
gatgccattgaaatgaaggaacaaca

SEQ ID NO: 469 - DNA, 32 bp, Diabrotica virgifera
ctaaccacaagttgttaattctgctgagatcc

SEQ ID NO: 470 - DNA, 544 bp, Diabrotica virgifera
gatgccattgaaatgaaggaacaacatatacctgtacttaccaaaggctcgttggcagatctagaccagttggacgaattggttattgagtactgtggtgttgaagaagttgaatctggagctatcagtaatgtacctaacctaagaaaactgtcacttaaaggtaatgccatcaagtcgattgcaaaggatgtattttcccatttaggaatatctacactagaccttagcctcaatcagatatcaacaatccatccacaggcctttgacaacatgccggatctcttaaacattcaacttgctgacaatttcataacgcaatggaatccagaatggctcaagaatacaccgctattgaccaggatctcgcttcagaataattccatagaaaagctaccagcccatgcatttaaaaacatggtaggtgataaaaagtatggaaaaatagacctcactattaatctggtatttagtcataataaaataagtgagatagatcctgaagctttcgcggatctcagcagaattaacaacttgtggttag

SEQ ID NO: 471 - DNA, 210 bp, Diabrotica virgifera
gagcgctgacataaccaaaaagcgcaagcgccaccacacaaaaaaccgtcttcattttcctgagtcgaacgaacctttcacaactcaccgtactaatggtactatggtactagctagcgaatgccaaatacaaacacgggctctttgccggcaaaagacttcttcctcactgaagatatcttgtaagttcttcctcttttcaaacgggcg

SEQ ID NO: 472 - DNA, 25 bp, Diabrotica virgifera
gctgacataaccaaaaagcgcaagc

SEQ ID NO: 473 - DNA, 33 bp, Diabrotica virgifera
ccgtttgaaaagaggaagaacttacaagatatc

SEQ ID NO: 474 - DNA, 203 bp, Diabrotica virgifera
gctgacataaccaaaaagcgcaagcgccaccacacaaaaaaccgtcttcattttcctgagtcgaacgaacctttcacaactcaccgtactaatggtactatggtactagctagcgaatgccaaatacaaacacgggctctttgccggcaaaagacttcttcctcactgaagatatcttgtaagttcttcctcttttcaaacgg

SEQ ID NO: 475 - DNA, 1139 bp, Diabrotica virgifera
tattttttttattcttaagttactgaaaaaattttggcgtgaatacttatgatctttttgtgaaaaagatcttactgtatattttaaatatgtaatttacttaactcattcgctgcctgtcaagaaaatggaactcggctagggccgttctgttaaaaggcgcctgactgattggcgcgtgaatggcacctgactgaagtaaccatatcacgcgctggagtgtgatcgtcagcgaatgggttaaatgacaagtggttatagatgtttatacagtctaaatatatacagtgagttaaatattgggtcgagctctccgtgggtaataataattattggttcaaaaggatccaaacttgtcacgggttagctctgccggacaatagattcagtaaaacacaggtttaatttaaataaaaatatatttttgtaatccaatacaataaaataacaacaaaatagtattcaattctccgactattgtctcccttttggcacccatatcgagccgctgttgatgaaatcgggtctcaagatatcgttggtaagttctctgcatagtcgaatgattcacattcaattgtcttgccacatacctttggtttgctccattttccgggaatgtaaccatctgaacacactttctatactttttcatcgttataaaaatagacttcactgtcaggaggccagtgtaccacgaagatatctcagaaactctttagaagactacaacagttcacacagttcttaaaaccatcaattctgcgaagcttcgttgattcgtaaataacgattggcacccatatcgagccgctgttgatgaaatcgggtctcaagatatcgttggtaagttctctgcatagtcgaatgattcacattcaattgtcttgccacatacctttggcttgctccattttccgggaatgtaaccatctgaacacactttctatactttttcatcgttataaaaatagacttcactgtcaggaggccagtgtaccacgaagatatctcagaaactctttagaagactacaacagttcacacagttcttaaaaccatcaattctgcgaagcttcgttgattcgtaaataacgattggcacccatatcgagccgctgttgatgaaatcgggtctc

SEQ ID NO: 476 - DNA, 26 bp, Diabrotica virgifera
ctcattcgctgcctgtcaagaaaatg

SEQ ID NO: 477 - DNA, 31 bp, Diabrotica virgifera
gcagagaacttaccaacgatatcttgagacc

SEQ ID NO: 478 - DNA, 444 bp, Diabrotica virgifera
cgctgcctgtcaagaaaatggaactcgcctagggccgttctgttaaaaggcgcctgactgattggcgcgtgaatggcacctgactgaagtaaccatatcacgcgctggagtgtgatcgtcagcgaatgggttaaatgacaagtggttatagatgtttatacagtctaaataaatacagtgagttaaatattgggtcgagctctccgtgggtaataataattattggttcaaaaggatccaaacttgtcacgggttagctctgccggacaatagattcagtaaaacacaggtttaatttaaataaaaatatatttttgtaatccaatacaataaaataacaacaaaatagtattcaattctccgactattgtctcccttttggcacccatatcgagccgctgttgatgaaatcgggtctcaagatatcgttggtaagttctctgc

SEQ ID NO: 479 - DNA, 851 bp, Diabrotica virgifera
actttaacgcctagtgtcgagtctcgtgtggcatatttcaacagatactcaaatattgtcatctaagaagctggaacagggatagtcactacgggcataactgcacaagcttgagaaggctaaagaaacctaactggtgtcgcctgataccaggaattgggtatactctccatctatatttgtttgcgcctttcaagtagacttgcacctagtctcgtttggcttctttcaatagatactcaaaccttttcgtctaagcaccacaaatgcacaccctttggacatttttcggccaatgttgagctctaccacggttttctgttctgttcctattctattcttgccccacaagaagctggggaattgatgatctctacggcataccctcacatgcgggaaaaggctaaagagatctatgtggtatcacctgcaagatctttttgtggataccctgcttcttttagaattaaagcgtttatttgaggcttttggatagactttaacgcctctagagcttttttgttttgtttcaacagatactcaaaccttttccaaattgaacttcttagcagtttttttattcgttcctagtctacacatgtcccaggagaagttactgagtcgcccctagcttcaactcgaccgtgcgcaccttataaatggcgcgtatacgtataatcctttcccgggcctaccacatcgaataaaaatgtttcttgattgatcgattacatgtttcttacattgtctgtgtatatgttgtaaatgcttgtttgtttgatgtgcctaaatccgttctatgtataaatacattcctagatacttcttatgagtgatgaaatcatagtgat

SEQ ID NO: 480 - DNA, 27 bp, Diabrotica virgifera
ctttaacgcctagtgtcgagtctcgtg

SEQ ID NO: 481 - DNA, 27 bp, Diabrotica virgifera
gaacggatttaggcacatcaaacaaac

SEQ ID NO: 482 - DNA, 797 bp, Diabrotica virgifera
ctttaacgcctagtgtcgagtctcgtgtggcatatttcaacagatactcaaatattgtcatctaagaagctggaacagggatagtcactgcgggcataactgcacaagcttgagaaggctaaagaaacctaactggtgtcgcctgataccaggaattgggtatactctccatctatatttgtttgcgcctttcaagtagacttgcacctagtctcgtttggcttctttcaatagatactcaaaccttttcgtctaagcaccacaaatgcacaccctttggacatttttcggccaatgttgagctctaccacggttttctgttctgttcctattctattcttgccccacaagaagctggggaattgatgatctctacggcataccctcacatgcgggaaaaggctaaagagatctatgtggtatcacctgcaagatctttttgtggataccctgcttcttttagaattaaagcgtttatttgaggcttttggatagactttaacgcctctagagctttttcgttttgtttcaacagatactcaaaccttttccaaattgaacttcttagcagtttttttattcgttcctagtctacacatgtcccaggagaagttactgagtcgcccctagcttcaactcgaccgtgcgcaccttataaatggcgcgtatacgtataatcctttcccgggcctaccacatcgaataaaaatgtttcttgattgatcgattacatgtttcttacattgtctgtgtatatgttgtaaatgcttgtttgtttgatgtgcctaaatccgttc

SEQ ID NO: 483 - DNA, 1612 bp, Diabrotica virgifera
ctcagctatgatatatatttcttaataaatcttatagtatcaacacatggattcttagaactactcttatatgactaaatttttacataatctctaaaaatcccagcatttcatgcttttctcttcataccctttcttcccagcttcaggcactataattatttactgtaagatttcgcattaatgatatagagcattttttatatgaaccataaaaagatcagtatgtttaaaatagtgtacctcgatggttttgatggttttttcgtttgttggattgattgtttaaaaatattatttgttttggtattggtttcaatgtgacaaaagtcaagaatcaagcatttttgttgtatccacagtaggaatagtatagcaaacaatattcaagtatttttatttaaaatgaaaaattatttttagctttttaggtcacctgttggcaaataaccttgaaaatgtagaacatattgctgatgaattatgattctcatatttgttttttatgagtcaaaatacgccgtaatattataacaatattatttatttaaattattataaaatcagaagattttcattaaatgatgaattaggattgaacgagctgtgataaattacccgaaaatatccacaatgttgccaaaagcaacattttggacacagtaatgcgacattacaggatgtattattttaactgtaaaaggattgtattcagacaaattaatgatagggcttgtccagatagatccatttatatctgttcgaacagtcaagcacctctaaaggctctggaagcacccaagcaagtcagctctaagttgattcttgaatgcaagatagcattgtctgattggtcagaggtgaaagatcctggattcgacctttacgcaaccgagctcaatgaaggagttacctctaaataattgtggctttctgtgagaccacaagtttattaaagcattagacgtgaggaacggcacgaaagagctcatatttagagaccctgctggttctagcagatatgggagctcgaaatagcctggaccccagaaacggcgaagagtatgttcttatgggcatagtctgggcgataggagcgacacaactgacccgccttagaatgtctaaagggctcccaaatgggtccttccccgatctaccatgacattattaacattgtgcttttggtaaaaagtacgctacacaacataatattttaaattctgcttagcgccaatgttagggggacctaatatgacacagaaataagcttatcgttcaaatctcggcaccaacgacattttcatttctacaaatgatacgagccgtgcaccgtacttcggaggacacgaaaagccgtcggtccccttgggctagtgtgcattgacactagctacttgaaacagggttaaagctgcaattgaccggaagctgtccgaaaggatcaccccggtaaaaataccatacgatattattatataatcatacaaaaacgctatatatcaataatacgaaaatttcttatgtaaaatgttttccaaaatatttctattatactcttaattataagacattctaaattttgcgaaataaactttaagctctgcttatc

SEQ ID NO: 484 - DNA, 28 bp, Diabrotica virgifera
ctcttcataccctttcttcccagcttca

SEQ ID NO: 485 - DNA, 30 bp, Diabrotica virgifera
gcacaatgttaataatgtcatggtagatcg

SEQ ID NO: 486 - DNA, 1081 bp, Diabrotica virgifera
ctcttcataccctttcttcccagcttcaggcactataattatttactgtaagatttcgcattaatgatatagagcattttttatatgaaccataaaaagatcagtatgtttaaaatagtgtacctcgatggttttgatggttttttcgtttgttggattgattgtttaaaaatattatttgttttggtattggtttcaatgtgacaaaagtcaagaatcaagcatttttgttgtatccacagtaggactggaatagtatagcaaacaatattcaagtatttttatttaaaatgaaaaattatttttagctttttaggtcacctgttggcaaataaccttgaaaatgtagaacatattgctgatgaattatgattctcatatttgttttttatgagtcaaaatacgccgtaatattataacaatattatttatttaaattattataaaatcagaagattttcattaaatgatgaattaggattgaacgagctgtgataaattacccgaaaatatccacaatgttgccaaaagcaacattttggacacagtaatgcgacattacaggatgtattattttaactgtaaaaggattgtattcagacaaattaatgatagggcttgtccagatagatccatttatatctgttcgaacagtcaagcacctctaaaggctctggaagcacccaagcaagtcagctctaagttgattcttgaatgcaagatagcattgtctgattggtcagaggtgaaagatcctggattcgacctttacgcaaccgagctcaatgaaggagttacctctaaatataattgtggctttctgtgagaccacaagtttatttaagcattagacgtgaggaacggcacgaaagagctcatatttagagaccctgctggtcctagcagatatgggagctcgaaatagcctggaccccagaaacggcgaagaggggtttatggtttattttcttaggggcatagtctggacgataggagcgacacaactgacccgccttagaatgtctaaagggctcacaaatgggtcctttcccgatctaccatgacattattaacattgtgc

SEQ ID NO: 487 - DNA, 919 bp, Diabrotica virgifera
ccctcacttatttactaagattccatcatatttctaagcgataaaatttagggaagaatttatgaaatgtcatcttaaaacgtgagagcaaattggcacaaacttgagcgttgaatcagtagtggataaacatcattcgaatgatgaatttgttttattctcacctgtaaaaaaaacaaagtgtaaatagtataagattaagtgtatattgatattagaaataaatggcggcgtaccaattttctaaaagaaggagttcttcaatcaaaaaggaattcaacgagagtgagctagaaggtctgaaaattgcttttgagctgctggatcggaaccaagatggacaggtcacaccgggagagttcaagatcatgctgaataatttaggaattgacattaagtattaaaaaagctgaagagataattaggattgccagtcattcaggctcagacttaatagaccaaaacgacttcctttctttcgttaaacagattcaaaaagcatgtccaggagacgtagacgaggatatagctagtgacctaaaggcagcctttcaagtttttgatttggacggagatggttatattacaaaagaggaattaaaaactgccatggaaatgattggggaagctgttacagatcaacaattggaacaggttattcgactggctgatactgataaggatggaaggataaactatgaagaatttgttaagttattaacatcgtaaagagagtaagaagaacaaagcttaaaatggttccaatgttctatggtaaatatttggttttaagtaaaagccaggctgtgatccatgtttacaattaaatatcattaagcaaacatattttgactgaattgagaaatatttaatggatatttttgtttcctaagtagatacctaggtaattattgtaaag

SEQ ID NO: 488 - DNA, 31 bp, Diabrotica virgifera
cttgagcgttgaatcagtagtggataaacat

SEQ ID NO: 489 - DNA, 27 bp, Diabrotica virgifera
ccttccatccttatcagtatcagccag

SEQ ID NO: 490 - DNA, 589 bp, Diabrotica virgifera
cttgagcgttgaatcagtagtggataaacatcattcgaatgatgaatttgttttattctcacctgtaaaaaaaaaacaaagtgtaaatagtataagattaagtgtatattgatattagcaataaatggcggcgtaccaattttctaaaagaaggagttcttcaatcaaaaaggaattcaacgagagtgagctagaaggtctgaaaattgcttttgagctgctggatcgtaaccaagatggacaggtcacaccgggagagttcaagatcatgctgaataatttaggaattgacattaagtatgaaaaagctgaagagataattaggattgccagtcattcaggctcagacttaatagaccaaaacgacttcctttctttcgttaaacagattcaaaaagcatgtccaggagacgtagacgaggatatagctagtgacctaaaggcagcctttcaagtttttgatttggacggagatggttatattacaaaagaggaattaaaaactgccatggaaatgattggggaagctgttacagatcaacaattagaacaggttattcgactggctgatactgataaggatggaagg

SEQ ID NO: 491 - DNA, 914 bp, Diabrotica virgifera
  modified_base (833)..(862): n = a, c, g or t/u
gttaaaaaaaacgctccctgacgctcttgcttccggttgcaccaaatgcaacataaaacaaaaagacacggctgagaaggtaatgaaacatcttatgtcaaggaggccgaaagactgggacagacttaccaagaagtatgatccacaaggaaactttaaaaaacgttacgaggaacacttgcaaaaagaaaagaaagcggcttagaaaattatctttaaagaagatgaaaagtcaaacattttgttgtgtttaataattttattgtaatttttttttcacttataggggagtgcaattagaacgaaaagatacaatgtttcggaaaaaatcaaacaaggttatatttttctaaaactttttttgttagtttataaatatgttaaagtaaaaacttctactcacaaattttgccgctaattgtttattaattgtttaaacaataacaattgctttgtataaataatgttaagaatatgggtgaattcaacattttattttgataaaaaatgtttttattttagttttgattatgctgaacccgaatctgacattacaatttgcaaattcaaaatggcggattttttcctaaaaatccttaaaaagtagttgtaaaatccgatttttttttataaaatgtgtttgtttgcatattatatgtggatatttttgagaggttgctgaacctgaataaaattttgataatttaaattataaaatggcagatccaaaatggcggatagcttaaaaaatagttgtaaaatcataatttctttacaagatgtatttatttctacatatatttatttttgagtgctttgataaacctaacttnnaatgtaacattataaactanntaaatgncggatccaaaatgcggcttttcataaaagaacataaaaaagacatttttcta

SEQ ID NO: 492 - DNA, 29 bp, Diabrotica virgifera
cggctgagaaggtaatgaaacatcttatg

SEQ ID NO: 493 - DNA, 28 bp, Diabrotica virgifera
gttcagcaacctctcaaaaatatccaca

SEQ ID NO: 494 - DNA, 616 bp, Diabrotica virgifera
cggctgagaaggtaatgaaacatcttatgtcaaggaggccgaaagactgggacagacttaccaagaagtatgatccacaaggaaactttaaaaaacgttacgaggaacacttgcaaaaagaaaagaaagcggcttagaaaattatctttaaagaagatgaaaagtcaaacattttgttgtgtttaataattttattgtaatttttttttcacttataggggagtgcaattagaacgaaaagatacaatgtttcggaaaaaatcaaacaaggttatatttttctaaaactttttttgttagtttataaatatgttaaagtaaaaacttctactcacaaattttgccgctaattgtttattaattgtttaaacaataacaattgctttgtataaataatgttaagaatatgggtgaattcaacattttattttgataaaaaatgtttttattttagttttgattatgctgaacccgaatctgacattacaatttgcaaattcaaaatggcggattttttcctaaaaatccttaaaaagtagttgtaaaatccgatttttttttataaaatgtgtttgtttgcatattatatgtggatatttttgagaggttgctgaac

SEQ ID NO: 495 - DNA, 802 bp, Diabrotica virgifera
catatttctcttttttgttagtttcgtattatctttttttacaattatcaaaaataagtaatacaacaggttttaagacatcaatatgacactaaaagtggttttatattttgggatgtatctaattgcagagatatctggacatgggatgatgttaaatcccccaggaagaagttctttctggaggtttaacgacactgcacctcgaaattttgacgataatcaagtgttctgtggtggagcttatgtccaaaatgaactgaatgatggcaagtgtggtgtatgtggagatccttatacagatcctcatccccaaagaaacgaaaataccggattttatggtataggaattgtcgtcaagacctatgaaccaggctcagttattgatgttaaaatcatgctaactgctaatcatctaggaaatttcacatacagtctatgtgaactcgaagattttgacgctccagaacctgaaaattgttttgaagatttgttactggaggatggttcagctaactataatgtagagtgggaagatgaagtagtcttcaataaggttcgactgccaaatttccaatgcgagagatgtgttcttagatggacttataaagcaggaaacaactgggggctatgtgaggatggaaaatggagaagaggatgtggacctcaagaacatttcatatcatgcgcagatattgcactattataattataaagacatttaacactattcagtaattttatagatcttatcctggataagcgcacccgcgtaccaaagaaggttgattgatggcaagct

SEQ ID NO: 496 - DNA, 27 bp, Diabrotica virgifera
ctttctggaggtttaacgacactgcac

SEQ ID NO: 497 - DNA, 26 bp, Diabrotica virgifera
gcttgccatcaatcaaccttctttgg

SEQ ID NO: 498 - DNA, 625 bp, Diabrotica virgifera
ctttctggaggtttaacgacactgcacctcgaaattttgacgataatcaagtgttctgtggtggagcttatgtccaaaatgaactgaatgatggcaagtgtggtgtatgtggagatccttatacagatcctcatccccaaagaaacgaaaataccggattttatggtataggaattgtcgtcaagacctatgaaccaggctcagttattgatgttaaaatcatgctaactgctaatcatctaggaaatttcacatacagtctatgtgaactcgaagattttgacgctccagaacctgaaaattgttttgaagatttgctactggaggatggttcagctaactataatgtagagtgggaagatgaagtagtcttcaataaggttcgactgccaaatttccaatgcgagagatgtgttcttagatggacttataaagcaggaaacaactgggggctatgtgaggatggaaaatggagaagaggatgtggacctcaagaacatttcatatcatgcgcagatattgcactattataattataaaaacatttaacactattcagtaattttatagatcttatcctggataagcgtacccgcgtaccaaagaaggttgattgatggcaagc

SEQ ID NO: 499 - DNA, 899 bp, Diabrotica virgifera
  modified_base (793)  (880): n = a, c, g or t/u
caactaaaagcttcttggggacatttgttgcaaatcatcaggaaaatgcatatcgagagcgagcagatgcaatttccaggagagttactacgatggaacctacatctacgactcctccagaactgataattccttcaattacgacaactctacctccaacaaccacaggcataaggacaagggtcgaaacgggcgacgaagctgtaagcttgggtttaccatgcgtgactgacatgcaatgcaaaatggctgattcatcttcaaaatgcatagaaggaatttgcgactgtattattcggacaaatggcacacgatcttgttcggctaaaaatcgtggatgtattcccggaacatttcagtgtcgaagcaccggtacatgcatcagttggtttttcgtttgcgatggtagaaaagactgcagcgatggatcagatgaagaatgcttacctaacaaatgtccccaagaagcttttagttgcaaatcatcaggaaaatgcatatcgagagcgagcagatgcgatggatccaaggactgtgccttgggagaggacgaaatgaactgtcaggctatcggaagaaaaggttgtccaccagatacttttcagtgcagagatgggaaatgtctacccgagtacgaattttgtaatgctataattggttgtagtgatggcagtgacgaaccacctcacatttgcaaaggacgagcgagaaggagaagaacagaatattgtcctttacgatgtggaaatggcagatgccgatctagcgcaattgcttgttctggaagagatgngtgcggtgatggcacagatgaaagtcaatgttcagtttgtagatgtcccgtgattaagagcgcacttatangtcgttaatttttcgnttgacttgtacatgccaaa

SEQ ID NO: 500 - DNA, 28 bp, Diabrotica virgifera
gcaatttccaggagagttactacgatgg

SEQ ID NO: 501 - DNA, 25 bp, Diabrotica virgifera
ggtggttcgtcactgccatcactac

SEQ ID NO: 502 - DNA, 617 bp, Diabrotica virgifera
gcaatttccaggagagttactacgatggaacctacatctacgactcctccagaactgataattccttcaattacgacaactctacctccaacaaccacaggcataaggacaagggtcgaaacgggcgacgaagctgtaagcttgggtttaccatgcgtgactgacatgcaatgcaaaatggctgattcatcttcaaaatgcatagaaggaatttgcgactgtattattcggacaaatggcacacgatcttgttcggctaaaaatcgtggatgtattcccggaacatttcagtgtcgaagcaccggtacatgcatcagttggtttttcgtttgcgatggtagaaaagactgcagcgatggatcagatgaagaatgcttacctaacaaatgtccccaagaagcttttagttgcaaatcatcaggaaaatgcatatcgagagcgagcagatgcgatggatccaaggactgtgccttgggagaggacgaaatgaactgtcaggctatcggaagaaaaggttgtccaccagatacttttcagtgcagagatgggaaatgtctacccgagtacgaattttgtaatgctataattggttgtagtgatggcagtgacgaaccacc

SEQ ID NO: 503 - DNA, 1103 bp, Diabrotica virgifera
gacatgttgttacaaaacattttggagagaagatcctgatgatgatgttgcagaccataaagtaagatacagtgaagattgtcaagcatttgttaatacgactgaagtaaaagaagagtttataaaagttacatgcagctacaacaatcgtgatatttatactgatttatttgcttttgtccctgtaaaaaacctatcggaaaatgtgaaaaacgatctgatccaagacgagtcctctttaaatattttagtgttgggcttagatgctatttcaagattaaattttcatagacaaatgccaaagacattaagttatttagaacaaattggagccgtagaaatgatgggatataataaggttggtgacaatacatttcccaatctaattccagcattaacaggaaaaactgtaaaggaaatcgagaacgattgctggccaactaaaacacaccattttgataaatgtccgttcatatggaagagctacaaacaaaaaggatatgtaacagctttcgacgaagactcttcttgggtgggaacatttaatcatataaaaaacggtttcaaaaaacaaccaacggactatgctttcaactattttgattttgaggctataagattactgggaaatactgggttggaaactgttgaaatttgtcaaggagcaaggtgggtatataaagttcatttgaactacttatccaatttcgttcgaacgatggaagataacttactaaagtattttggctttttctggcagaacagtatatctcatgatgatctaaatttacctagaataggtgatgatcattactactctatgtttaaatattttgggaaaaatggttatttcaatattacatttctcttcgttttgagcgaacattggaataaaaaactggtaaaaataagaaagacattcccagggcatggtgggaaaaaaagattaccgttacctttttgtatatttttcccaaattggtaataaaaaaacgatacccatcccggaaaattaaaaaatttaaaaaaaaaaattttttttggcgtttaacaacacccctttttgtattttttattggaaaattttttttttcttttggttt

SEQ ID NO: 504 - DNA, 28 bp, Diabrotica virgifera
ggagagaagatcctgatgatgatgttgc

SEQ ID NO: 505 - DNA, 30 bp, Diabrotica virgifera
cgaacgaaattggataagtagttcaaatga

SEQ ID NO: 506 - DNA, 691 bp, Diabrotica virgifera
ggagagaagatcctgatgatgatgttgcagaccataaagtaagatacagtgaagattgtcaagcatttgttaatacgactgaagtaaaagaagagtttataaaagttacatgcagctacaacaatcgtgatatttatactgatttatttgcttttgtccctgtaaaaaacctatcggaaaatgtgaaaaacgatctgatccaagacgagtcctctttaaatattttagtgttgggcttagatgctatttcaagattaaattttcatagacaaatgccaaagacattaagttatttagaacaaattggagccgtagaaatgatgggatataataaggttggtgacaatacatttcccaatctaattccagcattaacaggaaaaactgtaaaggaaatcgagaacgattgctggccaactaaaacacaccattttgataaatgtccgttcatatggaagagctacaaacaaaaaggatatgtaacagctttcgacgaagactcttcttgggtgggaacatttaatcatataaaaaacggtttcaaaaaacaaccaacggactatgctttcaactattttgattttgaggctataagattactgggaaatactgggttggaaactgttgaaatttgtcaaggagcaaggtgggtatataaagttcatttgaactacttatccaatttcgttcg

SEQ ID NO: 507 - DNA, 813 bp, Diabrotica virgifera
tgaagtgaaagattgctaaggtgaaattgaatcggttacgggggactgtacaattgtcggttttagtgttaaacatttttgagaaaaaatggccagtttttgggccgtttttgtttttggagttgcattcacacttacagagcactgccacggagctcagtacttcggaaaactcataggaaaactttcggaattacaccacggcgtctccggagaagtttacgcagtagatgcgaggactttgtacatcaaggatttcacttatgacggacaaggacccgccgcttatttttacgccagcgtccacaaagcggctgacaaacacggtttccggttgagagatgagacgggaagcggagaagtaatcaggaggtacaggaaggagggaatcactctcacgctgccagaaggaaagaccatacacagcatcaagatattttatctttggtgcgaggaatttgacgttaactttggtgatgttaaagttcctcgtggttttgactatccacgaccacaaaaaattgaatctctcaaaggtgtccacgcaatttcgtcagacaacatcgtcatcgtggatgcccagacgctgttgattccaaacttgtcttatgatggcgaagcaccagatgccaaattctcgggttggtcgtggcagcaaacctactccacaaggtatccgagtccctgacgagaatggcaaagaagtgccccttagaagatatgacagaaagacagtggtacttacacttccaggcgatttgacagtttttgacattggacattttggaatctggtgcgagatgtttactgttg

SEQ ID NO: 508 - DNA, 27 bp, Diabrotica virgifera
tgctaaggtgaaattgaatcggttacg

SEQ ID NO: 509 - DNA, 27 bp, Diabrotica virgifera
caacagtaaacatctcgcaccagattc

SEQ ID NO: 510 - DNA, 799 bp, Diabrotica virgifera
tgctaaggtgaaattgaatcggttacgggggactgtacaattgtcggttttagtgttaaacatttttgagaaaaaatggccagtttttgggccgtttttgtttttggagttgcattcacacttacagagcactgccacggagctcagtacttcggaaaactcataggaaaactttcggaattacaccacggcgtctccggagaagtttacgcagtagatgcgaggactttgtacatcaaggatttcacttatgacggacaaggacccgccgcctatttttacgccagcgtccacaaagcggctgacaaacacggtttccggttgagagatgagacgggaagcggagaagtaatcaggaggtacaggaaggagggaatcactctcacgctgccagaaggaaagaccatacacagcatcaagatattttatctttggtgcgaggaatttgacgttaactttggtgatgttaaagttcctcgtggttttgactatccacgaccacaaaaaattgaatctctcaaaggtgtccacgcaatttcgtcagacaacatcgtcatcgtggatgcccagacgctgttgattccaaacttgtcttatgatggcgaagcaccagatgccaaattctgggttggtcgtggcagcaaacctactccacaaggtatccgagtccctgacgagaatggcaaagaagtgccccttagaagatatgacagaaagacagtggtacttacacttccaggcgatttgacagtttttgacattggacattttggaatctggtgcgagatgtttactgttg

SEQ ID NO: 511 - DNA, 1550 bp, Diabrotica virgifera
aaagactcgttttaagtaggtgtgtaaaaatttttatgaaataatataaaaaaaacgtgtcgattcctgtgtatattaaaaattggggttagattgtattaacttattatctgcacacaatttctgaggaagttaacaaataatatttcctgagccgaaactgaaagaatacagcatgcatcacagtaattaaaaaaaatctattatctgtatctgttattataatagtctcccgttttataccgctaaagcggctttgggattatagcagggtagtctgctatatctagtgcctacggtatacaagaaaggtaacagggtcagtgctacgcttcaaccgcctattattacccctggttttacccaaagtactaattttattcaggctgagtcgacctggggcctatagacatttttaaaaatgtctagatgttctcgccggcgcgggtttcgaaccccggcctaccagcatgcgagtcagatatcctacagcctgagctacggcggcccttattaaatagcaaaatgttaacggacaaattaacaataattttatatatcttaaggtctaggttatagcgtatttttaatcgactaataaattatttaacatatccattatttgaatcaaaaataaagaagccattctaaaatttacataaagacacataataatatattaactaacttcttgaaaatacgccactgaatgaatgcagaaaatctgatcgtttcgccggacgggccttaggtaactcttagcgaaaatcgccattttgcgcacgttattcgcactatacgttatacattgtaacgctagacatacccagactagtagatacttagcccaaacctaataatgttaaaaatcaatcgttatctaccaccaattttatcggatcaggaatatagtacaaatttaataactaaaggcagctataaagcaaatatagattgtcttgaaatttgatttaaatgaaattttgaaaccgcaaaaagacattcatggaatattgaaaattgtaaaagatttatgaaatttctaatcatttctttttcctaacaagtagaatccagttcaataggactagctttgaaatgcaaaactatattacgcaataatgacatgtaatcctaaaaattttaatattaaatgactaatgaacattacaaatttattaatacattgatagtttcgatgtgactcgataaatcaaacgtattttggtagcgtaaaaaccaaggaaacagtattgaagacattttaaatttttccacatatattgacttttttcatagaaatcgaattaaaagtggttttatttcactttaccttctaattgtttattaataactttaaatagttaattaacttattacttctaagaattttaacaaacaaaagatttggttatttttttataactttaccatgcttaataattttacacttaatttaatagcaccaaaatttacatgtttataatttatataaacataaatcaagttttgcataatgcagaacgaaattttggaattttagtttaatc

SEQ ID NO: 512 - DNA, 31 bp, Diabrotica virgifera
cagggtagtctgctatatctagtgcctacgg

SEQ ID NO: 513 - DNA, 34 bp, Diabrotica virgifera
gctagtcctattgaactggattctacttgttagg

SEQ ID NO: 514 - DNA, 824 bp, Diabrotica virgifera
cagggtagtctgctatatctagtgcttacggtatacaagaaaggtaacagggtcagtgctacgcttcaaccgcctattattacccctggttttacccaaagtactaattttattcaggctgagtcgacctggggcctatagacatttttaaaaatgtctagatgttctcgccggcgcgggtttcgaaccccggcctaccagcatgcgagtcagatatcctacagcctgagctacggcggcccttattaaatagcaaaatgttaacggacaaattaacaataattttatatatcttaaggtctaggttatagcgtatttttaatcgactaataaattatttaacatatccattatttgaatcaaaaataaagaagccattctaaaatttacataaagacacataataatatattaactaacttcttgaaaatacgccactgaatgaatgcagaaaatctgatcgtttcgccggacgggccttaggtaactcttagcgaaaatcgccattttgcgcacgttattcgcagtatacgttatacattgtaacgctagacatacccagactagtagatacttagcccaaacctaataatgttaaaaatcaatctttatctaccaccaattttatcggatcaggaatatagtacaaatttaataactaaaggcagctataaagcaaatatagattgtcttgaaatttgatttaaatgaaattttgaaacagcaaaaagacattcatggaatattgaaaattgtaaaagatttatgaaatttctaatcatttcttttttcctaacaagtagaatccagttcaatggataagg

SEQ ID NO: 515 - DNA, 1452 bp, Diabrotica virgifera
  modified_base (1400)..(1420): n = a, c, g or t/u
aataaataaaccaatttaatatattagaacatttttaataatacttttattttaaatcaatgtattcataaataatcttgtcactggcatactagcaaaaaccatgtaacttaaaactcatttcataaagtttataagttatgctgatgagttttgttatcagaagattacgtacctatcagcttttaatcattcgcatactttggtgtgtttttatcaaataaggctaataagaaaattcatgataaaacattcggaaatgtttaaatacaacacgcaattaaaaaaaagcagcataaaatttagacgaattagtacaaagtgtacctacttaaaatttacctttttgagtaattttttatgctgagaatttaaaaaaaaatccgataattttgtctaaaagtacagaaaatattttttttaggttatactttaataagttacatggttttgaatagcatttgaaatgttttctaagtactagctaggatttttttatttattatctaatcaatcacattttacactaatattctcaaaatcacatttagattttaataaaaaaattctccatttgtaaaatttaaattgttctccatagtaaatgcaaatttataaagtaaaaaaacactaaactatctatcattaatataggtcccatagataataataaatagaaagaatattataatagttattttcctaagaagtgcagatagtcattattttccgcacgcgactgcagtttgccgaacgacgcgaagcgggagttcggcaaccagtcgagtgcggaaaagagactttctgtaagagttaggaacaatattttttacgagtctttaaaaaattaccaaatcttaatcaattaatttaattaatatgaaaatacatacacaaattaattctttgagaaggttgtcaaaaccaaactttcaatataattagttagcatgacgacgatcttggtttccatgacgatgattcaaaacgactgttattgtctaccgatttgactttcgaatattatgtcaaaataattatatttcatcgaattgtcgcgttaatttcaggaacacaatacaagatatatttgaaataaattagtaaataatatctaaatattagtttattgcatgtattataattactttaaggccatattaacatatctaaattaacacgcgtgcggaaaagtaacacgcgtgcggaatagtgaaactttctaaactaaaatgggtgcgcgaaagtagacatttttgcacgctcgtagaaaaatgatttattgacgtttcgacttccacttcggaggtcgttatctaaatacaaaatactcgacaaactgaaaagtcgccgaattgcgtcccagtggggatttcaatgatctttgaaatttcccttanatagatggactagctggttntcgcttcagagatgtacactctgctctgctga

SEQ ID NO: 516 - DNA, 31 bp, Diabrotica virgifera
tgctgatgagttttgttatcagaagattacg

SEQ ID NO: 517 - DNA, 27 bp, Diabrotica virgifera
ggaaaccaagatcgtcgtcatgctaac

SEQ ID NO: 518 - DNA, 828 bp, Diabrotica virgifera
tgctgatgagttttgttatcagaagattacgtacctatcagcttttaatcattcgcatactttggtgtgtttttatcaaataaggctaataagaaaattcatgataaaacattcggaaatgtttaaatacaacacgcaattaaaaaaaagcagcataaaatttagacgaattagtgcaaagtgtacctacttaaaatttacctttttgagtaattttttatgctgagaatttaaaaaaaaatccgataattttgtctaaaagtacagaaaatattttttttaggttatactttaataagttacatggttttgaatagcatttgaaatgttttctaagtactagctaggatttttttatttattatctaatcaatcacattttacactaatattctcaaaatcacatttagattttaataaaaaattctccatttgtaaaatttaaattgttctccatagtaaatgcaaatttataaagtaaaaaaacactaaactatctatcattaatataggtcccatagataataataaatagaaagaatattataatagttattttcttaacaagtgcagaaagtcattcttttccgcacgcgactgcagtttgccgaacgacgcgaagcgggagttcggcaagcagtcgagtgcggaaaagagactttctgcaagcgttaggaacaatattttttctacgagtctttaaaaaatgaccaaatcttaatcaattaatttaattaatatgaaaatacatacacaaattaattctttgacaaggttgtcaaaattaaacttcagcataattggttagcattacgacgatcttggtcc

SEQ ID NO: 519 - DNA, 1380 bp, Diabrotica virgifera
gagtttcttcttgcgtaaataatttggtatttttttatgtttattgattccgtttatcccttccatttttttcgattattattcctgtggaatagattcgcgttttctagtgtcttctcgtactaatatctcctctatagaaactaaataatataaaaaatatataagacaaatataaaatctgttacacaactgtcattagagattgaaataaagcttaagattttttaacttgcctacaatagagttgataacaggttttgtttcacatctctatacttatgcctgtaaactgtagaatctgttccgaatgtcagcattaagttacacattaactgccgatatctgttctttcttaaataattgccagaaaatttcgtctaatcttcaacgccataaatgcaatgtaaaaattaatcttagtatacttgtgagtgcagaaggtgtgctattgcctttttaaacacatggcatacttacattatattatcgttaaatgtattcctatccagacctcgttccaacatattgcggctaggagcagaagaataagacagctgacaagctaacctactgacagttgacattgacattattattatgaatgacacaaaatgtatttaagttcagtcatcatttttatataaaattcacatcttattgctaaatattattttccagttatttgattataaagatcagtgcaacgtagtagcctatataaatattctaaatctactcacagccaagaagaaacaggctaaacccgctaccttattcggaaagttggttacgtgatgattatgaatttgactctttttattagctgtgaatatgtatttagtaataaaatatactttatatcaaaacggtaactttgcttcacaatagggctatttattgcatcattgccaccatttttctcgcacacttgacatatgacatacaatatgcgtcatacgtctttgatatataattggtatataccaatgacgtattacgtatatattgtacgtcatatgtcaatagccatctggaacatgcgcatatcgtaatatttcactattatctcaactgtcacttacctctgcaaacaggtattcaaatgcaggtctggaaactggctttggttaagattacgcctaacggtagcataatgtaggtgtgttataactaaaaataaaaagaatcctacacttacggacacctacgatatgtgttaagcactgttaaaatgctatagttctattataaggaacaaaaaagatgaatatgcaagaaattaataatattgttataaattaccagaagataagtgttaactgtacttcatagagtctagattatcctaataatacttagataataatcagttttaag

SEQ ID NO: 520 - DNA, 32 bp, Diabrotica virgifera
cttgcctacaatagagttgataacaggttttg

SEQ ID NO: 521 - DNA, 31 bp, Diabrotica virgifera
gcttaacacatatcgtaggtgtccgtaagtg

SEQ ID NO: 522 - DNA, 993 bp, Diabrotica virgifera
cttgcctacaatagagttgataacaggttttgtttcacatctctatacttatgcctgtaaactgtagaatctgttccgaatgtcagcattaagttacacattaactgccgatatctgttctttcttaaataattgccagaaaatttcgtctaatcttcaacgccataaatgcaatgtaaaaattaatcttagtatacttgtgagtgcagaaggtgtgctattgcctttttaaacacatggcatacttacattatattatcgttaaatgtattcctatccagacctcgttccaacatattgcggctaggagcagaagaataagacagctgacaagctaacctactgacagttgacattgacattattattatgaatgacacaaaatgtatttaagttcagtcatcatttttatataaaattcacatcttattgctaaatattattttccagttatttgattataaagatcagtgcaacgtagtagcctatataaatattctaaatctactcacagccaagaagaaacaggctaaacccgctaccttattcggaaagttggtcacgtgatgattatgaatttgactctttttattagctgtgaatatgtatttagtaataaaatatactttatatcaaaacggtaactttgcttcacaatagggctatttattgcatcattgccaccatttttctcgcacacttgacatatgacgtgcaatatgcgtcatacgtctttgatatataattggtatataccaatgacgtattacgtatatattgtacgtcatatgtcaatagccatctggaacatgcgcatatcgtaatatttcactattatctcaactgtcacttacctctgcaaacaggtattcaaatgcaggtctggaaactggctttggttaggattacgcctaacggtggcataatgtaggtgtgttataactaaaaataaaaagaatcctacacttacggacacctacgatatgtgtaagc

SEQ ID NO: 523 - DNA, 1253 bp, Diabrotica virgifera
cgtccgtcttcatcttctaatctagaacaatatgttacaagcctgttcaatgcagaaggatggagaaagtattctaacttattaggcctagccctggattggttaggatctttgtctgtatcgtcaaccaatacagatcaatttgaatataaactttcaaatttgatacataaattaagagtcattacctatgcttgtaattaggaattattgtactctcaaaataattaatattaaatccagtagtgattgatcatattggaaggtaaagtacaggacaaaagattagtaagaagacgctcgaactcgtggctgaaggacctgacaaaacggtttgaccgctcatccgcagaaatttttcttgcagcagttttcaaagctacagttgccatttggatcgccaatctttgaaaggagacggcgcaataagaagaaatgattgatataacctcaacaaacagtgacttactttactttcattatcaacaaaacaaatgttttgtagagaaagcaaactagtgctgctgctagtggtgaattaatatactaatgattaaagccactttcagtctgaatagtactatgttaagggttccatttacgttgagataggtatcgatacatgtatcgcgacaagttgcgatacacgtatcgtgagatttgtgtctgtttcacgacagagatgcatgcgacgatagagttgtagacgacgaagattgagagttgtgatactgatacagcgatactgagacagccaaatacacgatgagatttgtatcacgatactggtacttgcgacatatatcttaaaattctaaaatttttaatctttctacagaagtatcttataattagaaattgtttataatataaatgaaaaatttatttaactttactctagattatttaataaaacaattctagtttaattgtattaatattattatatttacaataaaaccaagtttaagaatattctcatgtataataaatgaacttcaaaaacgacagacactatcttgacacatcttgtaaataatcacatgtgttaaatttttgttataaaatattttatatgtataatgtttacttttatttaatacgtttgtttaattgttgggacatttgtaatactgtagcaaaaaccgaaaatattatttatttgcgattgcaatgacatgatgttatttcatttaaatgtaagattatgtgtgatctttagcgtaacatgaaataaagttttataatattgg

SEQ ID NO: 524 - DNA, 22 bp, Diabrotica virgifera
gacgctcgaactcgtggctgaa

SEQ ID NO: 525 - DNA, 33 bp, Diabrotica virgifera
gctacagtattacaaatgtcccaacaattaaac

SEQ ID NO: 526 - DNA, 845 bp, Diabrotica virgifera
gacgctcgaactcgtggctgaaggacctgacaaaacggtttgaccgctcatccgcagaaatttttcttgcagcagttttcaaagctacagttgccatttggatcgccaatctttgaaaggagacggcgcaataagaagaaatgattgatataacctcaacaaacagtgacttactttactttcattatcaacaaaacaaatgttttgtagagaaagcaaactagtgctgctgctagtggtgaattaatatactaatgattaaagccacttccagtctgaatagtactatgttaagggttccatttacgttgagataggtatcgatacatgtatcgcgacaagttgcgatacacgtatcgtgagatttgtgtctgtttcacgacagagatgcatgcgacgatagagttgtagacgacgaagattgagagttgtgatactgatacagcgatactgagacagccaaatacacgatgagatttgtatcacgatactggtacttgcgacatatatcttaaaattctaaaatttttaatctttctacagaagtatcttataattagaaattgtttataatataaatgaaaaatttatttaactttactctagattatttaataaaacaattctagtttaattgtattaatattattatatttacaataaaaccaagtttaagaatattctcatgtataataaatgaacttcaaaaacgacagacactatcttgacacatcttgtaaataatcacatgtgttaaatttttggtaaaaatattttatatgtataatgtttacttttatttaatacgtttggttaattggttgggacatttgtaatactgtagc

SEQ ID NO: 527 - DNA, 1205 bp, Diabrotica virgifera
attgacttttactgctgtctattactgtagcggagctattgagctttaccttactaatcaatcaccctgtatacctagatagacttttagtatagaaatataaaaaatatgcaaaatgcatatgttattaacttctgtaatcctgaatttcctaaaaaataattaaatgttgaccttacgaattataccgttacgaatatgtagttacgaactctcgccgttacgaattgtccgttaccatttgtcgggttacgaactgtcgcgttacgagatgtcatggaaccataataacacacgcaaggataaaaagatacaaggataagataacagattgtacgtggccgacattatcagttatgtttggagataaaatggttccggttcgttagaatttaacagaaatattcaagtgttcaaggttagaaaactaaactgtttgattaaaaaaaattttttttcattaatttctaagtaaaaataccattttatgttcaaagagccgatattgtagcccccttaataattatttttatgtttgtcccttgtccagtgtgtgttatctatttgtattatttttaattaaatgtctgacattccgggatttgctggataacttccttttttgacggaatgccccctgatgatgctatgagagcgaaactacttgggcaaaatttaataaataactgctcgatatctgcgttttatttgtaaaattcatatattcgagcattgaactatatattattgaattgtaatatagttaaaaggcaattaagataaatttttacagagtttatcgtgttcttctatgattattaaataattctagtttatttgttatctcattactagatctagtaagagataacccatgaattttttaaaatgtttatccaattctgatatatctgttaagtacataataatgaacctattaaataagtcgcagattctacatagtaaaaaaaacttgtttcaataaatttgaaagttcaaaacgctttatccagaaagtttgtaaatatatcaaaaatattatcagtagtaattgcacaagagctctaaaattattgaatttttcccgagtgacactttgacagttttaatttcacgagccgaagtgtcacgagggcaaaatactatattaattttagagatcgagtgcaatttgttgcgattatttcatgaataaaactgttcaa

SEQ ID NO: 528 - DNA, 31 bp, Diabrotica virgifera
gctgtctattactgtagcggagctattgagc

SEQ ID NO: 529 - DNA, 36 bp, Diabrotica virgifera
ctatgtagaatctgcgacttatttaataggttcatt

SEQ ID NO: 530 - DNA, 947 bp, Diabrotica virgifera
gctgtctattactgtagcggagctattgagctttaccttactaatcaatcaccctgtatacctagatagacttttagtatagaaatataaaaaatatgcaaaatgcatatgttattaacttctgtaatcctgaatttcctaaaaaataattaaatgttgaccttacgaattataccgttacgaatatgtagttacgaactctcgccgttacgaattgtccgttaccatttgtcgggttacgaactgtcgcgttacgagatgtcatggaaccataataacacacgcaaggataaaaagatacaaggataagataacagattgtacgtggccgacattatcagttatgtttggagataaaatggttccggttcgttagaatttaacagaaatattcaagtgttcaaggttagaaaactaaactgtttgattaaaaaaaatttttttcattaatttctaagtaaaaataccattttatgttcaaagagccgatattgtagcccccttaataattatttttatgtttgtcccttgtccagtgtgtgttatctatttgtattatttttaattaaatgtctgacattccgggatttgctggataacttccttttttgacggaatgccccctgatgatgctatgagagcgaaactacttgggcaaaatttaataaataactgctcgatatctgcgttttatttgtaaaattcatatattcgagcattgaactatatattattgaattgtaatatagttaaaaggcaattaagataaatttttacagagtttatcgtgttcttctatgattattaaataattctagtttatttgttatctcattactagatctagtaagagataacccatgaattttttaaaatgtttatccaattctgatatatctgttaagtacataataatgaacctattaaataagtcgcagattctactg

SEQ ID NO: 531 - DNA, 1194 bp, Diabrotica virgifera
aaaacgtaagtctttctttcggccacgggaacggaacaggttagtccgtaacaacagagaaaaagtttcgttaaatcacttcgtatcaatcttcggcatcatcttaaaattttcttcagaatcagtaggaaaactcaaagtaggttattctcatcggttacattcgttcttcggggtttatagaccgagctcggaattatttcttcctcggcctcgcaacttccatcgagacgtcaaaggcagcgtgtaaactatcaatgagtagaagacagttcataacggtcttctacccgacagttatgacctatgttgcatagtcttcgatgtctgtcacagttgaaaggcacaagaaagaaatagatccacatcacgaccaattataaagcccaaaaagaatttaccattacagaacaccagccgtgaaggcttacattcctcaaaatcatgtcagtcatatgtggggatggtgacatggttatagtcatggggttttatggtattatttctatacatggttttgaataatgtaagtctcgtcattaaatatgtatctgacaatacatttgaatttaaatactcgagattaaattataagcaatgatcagaagaaatgagatacttagtgccttggatatgtgttaaccattgcttcgcttttttaaagacaaatgttcactgcacaatgtaaaacgactagtaactagtaaaacaaaaattccctggtttgttcttgcagactattaaaaagaagtagtttttaatagctgatggacaaaacaggcacaaatattgacaaattgcacagtagtgaggctccaaaagccttagtaattaggaacaaaatctttaaatagctctttaataaaatgttttatacttacatgaaaaggttgcagccacccatccttggaatagttgatgaaagagaaagaatttaatgaaggtgaaaatgaaacatgatatgaaccagatgagatgtgataggaatgtggatttggaaacgaaggactatggatattaaaaaaataaggtgatggcaaaattcaccttaaaaaggcaacttcctgaagggaagttacttaacccacctccacccagtccgaatatttcttgaggagaaatattcggcctacttactaaaatatattgggggatcaagacaaattatgatccctgcatttggcttaaatcttg

SEQ ID NO: 532 - DNA, 29 bp, Diabrotica virgifera
agtccgtaacaacagagaaaaagtttcgt

SEQ ID NO: 533 - DNA, 28 bp, Diabrotica virgifera
gaggtgggttaagtaacttcccttcagg

SEQ ID NO: 534 - DNA, 1031 bp, Diabrotica virgifera
agtccgtaacaacagagaaaaagtttcgttaaatatttgtataattttcggcatatcttaaaatttcttcagatcagtggaaaactaaagtggttatctcatggttacattgttcttggggtttatagaccgagctggaattatttcttcctggcctgcaacttccatgagacgtcaaaggcagcgtggaaactatcaatgagtaggagacagttcataacggtcttctacccgacagttatgacctatgttgcatagtcttcgatgtctgtcacagttgaaaggcacaagaaagaaatagatccacatcacgaccaattataaagcccaaaaagaatttaccattacagaacaccagccgtgaaggcttacattcctcaaaatcatgtcagtcatatgtggggatggtgacatggttatagtcatggggttttatggtattatttctatacatggttttgaataatgtaagtctcgtcattaaatatgtatctgacaatacatttgaatttaaatactcgagattaaattataagcaatgatcagaagaaatgagatacttagtgccttggatatgtgttaaccattgcttcgcttttttaaagacaaatgttcactgcacaatgtaaaacgactagtaactagtaaaacaaaaattccctggtttgttcttgcagactattaaaaagaagtagtttttaatagctgatggacaaaacaggcacaaatatcgacaaattgcacagtagtgaggctccaaaagccttagtaattaggaacaaaatctttaaatagctctttaataaaatgttttatacttacatgaaaaggttgcagccacccatccttggaatagttgatgaaagagaaagaatttaatgaaggtgaaaatgaaacatgatatgaaccagatgagatgtgataggaatgtggatttggaaacgaaggactatggatattaaaaaataaggtgatggcaaaattcaccttaaaaaggcaacttcctgaagggaagttacttaacccacctc

SEQ ID NO: 535 - DNA, 1024 bp, Diabrotica virgifera
cggacgcgtgggctttttggacaaagtatttggtggtttcttagtcctcgaaatctctagatttggattgatttaatttacattattgtcattgtcaaaaagtacatagggcattgcaacatgctgtcaaatctaaatcaatatgggggctggtaggcaaacctaaatgtcattctatcagttttcaatgtgttttagatcattttagttgcgtttctttgtaattttgttttgtacaatgattaattaacattttcactggaagaaataatgtaaaaagataatatgcctgatttatgttgtgttttgaagtgtataatgcgaagtcatcatgataaaaagttcagttttattggttgccatcagtgctacattttaagcataaacaactaaataaagttatcatcttagggacaaaaacaatggttaaatgctataaaacgtcctataaaaatgctaaataactatatccgtgttactcaagcttggaaaactgtctccaccgtaggctaacaccgaccacttgaggaaaatggacctatattgtacaaagactgtgccaattacagagatccttcattatggatttcttcaagatttgtaaatgtcctctgtaataactattattcaccataggtcagtaattattgatttctaaccttcaaaatagtcgagaagtgacctattatttactttactatctccactgtctaggaaagtacttatcggctatcatatgtcactttccttgccgtcaaatgtcacttgtcataaatgtcaaaataatttatcaaattataataaaagttaatgtagatattattatttgaaacttaattattaatgatatattatgactaaaatagtatacatatgtatactcgggagaatgtatttcagcctcgcgtctgtagcttactttggtaattcctgaacaagctaatttgacaatcaattctcctgggcaatatgtaatatactatgactcttagtgatatcgacttagtcgtaaaccactggttct

SEQ ID NO: 536 - DNA, 31 bp, Diabrotica virgifera
gacaaagtatttggtggtttcttagtcctcg

SEQ ID NO: 537 - DNA, 31 bp, Diabrotica virgifera
gttcaggaattaccaaagtaagctacagacg

SEQ ID NO: 538 - DNA, 917 bp, Diabrotica virgifera
gacaaagtatttggtggtttcttagtcctcgaaatctctagatttggattgatttaatttacattattgtcattgtcaaaaagtacatagggcattgcaacatgctgtcaaatctaaatcaatatgggggctggtaggcaaacctaaatgtcattctatcagttttcaatgtgttttagatcattttagttgcgtttctttgtaattttgttttgtacaatgattaattaacattttcactggaagaaataatgtaaaaagataatatgcctgatttatgttgtgttttgaagtgtataatgcgaagtcatcatgataaaaagttcagttttattggttgccatcagtgctacattttaagcataaacaactaaataaggttatcatcttagggacaaaaacaatggttaaatgctataaaacgtcctataaaaatgctaaataactatatccgtgttacttaagcttggaaaactgtctccaccgtaggctaacaccgaccactggaggaaaatggacctatattgtacaaagactgtgccaattacagagatccttcattatggatttcttcaagatttgtaaatgtcctctgtaataactattattcaccataggtcagtaattattgatttctaaccttcaaaatagtcgagaagtgacctattatttactttactatctccactgtctaggaaagtacttatcggctatcatatgtcactttccttgccgtcaaatgtcacttgtcataaatgtcaaaataatttatcaaattataataaaagttaatgtagatattattatttgaaacttaattattaatgatatattatgactaaaatagtatacatatgtatactcgggagaatgtatttcagcctcgcgtctgtagcttactttggtaattcctgaac

SEQ ID NO: 539 - DNA, 1017 bp, Diabrotica virgifera
tataaaatctggcaactgtgcagtgtagtacaaccctcgccactcacagacagcggacgggatgatcgcatcgcatcgtgccaaaagcttagatggctcagctgaaaagagaaagattttacgggcattctatgtaagtgacagagatagagctatattgcacttttaatacacgtttaaatgaaactattcgtgcctggcccgacaaggcaggaagatctaatattttttactatgctcatcatagtgaatagtggatcgtagatcagatccaaaaagcttctcgtacagggtagtacctacattatcttttcgagtttttttacgcgctcgctcgctcgtttttgtatttataattattacatttttaatgattaaactttttattctaaactattatatttttaagtaatttaaaatttttaataaaacccgagttaaattcagcttatcgtgatagtctaattaaacacaatgaacaagaagtggattaagaatcgatatgttttgaatcaaattaaaaattatatctaagtatatggttttgtggagctttcgagttagttttgagaaatcacgacgaaaaggaaaattcagaaaatataggcatctttatggaactgttcaatgttagccgaattagacaacgacttcggttaatattcaaagttccaaatctttaaaagcatgtacctcaaaacaacacaaaatgaactccttcagtgcatcttagatgtttatcacgaggaaataaggaaagaaattgaaaattatctttgtgttgcagtgattgccgatgaaacgacagacgtcgcgtcgctggtgaatttcagttagttatagttttccgatatttgtgtaaagggcgataagttgagagattttggagattttacttgttggacggacatgatgtcaaatcaatcactgaatgcattttaaatgtttaaatttcttgacaccccagaaatggtatatacctacataatgtaaaaatatccgtacctatttttttta

SEQ ID NO: 540 - DNA, 27 bp, Diabrotica virgifera
caactgtgcagtgtagtacaaccctcg

SEQ ID NO: 541 - DNA, 27 bp, Diabrotica virgifera
cagtgattgatttgacatcatgtccgt

SEQ ID NO: 542 - DNA, 922 bp, Diabrotica virgifera
caactgtgcagtgtagtacaaccctcgccactcacagacagcggacgggatgatcgcatcgcatcgtgccaaaagcttagatggctcagctgaaaagagaaagattttacgggcattctatgtaagtgacagagatagagctatattgcacttttaatacacgtttaaatgaaactattcgtgcctggctcgacaaggcaggaagatctaatattttttactatgctcatcatagtgaatagtggatcgcagatcagatccaaaaagcttctcgtacagggtagtacctacattatcttttcgagtttttttacgcgctcgctcgctcgtttttgtatttataattattacatttttaatgattaaactttttattctaaactattatatttttaagtaatttaaaattttttaatttttaataaaacccgagttaaattcagcttatcgtgatagtctaattaaacacaatgaacaagaagtggattaagaatcgatatgttttgaatcaaattaaaaattatatctatatggttttgtgaagctttcgagttagttttgagaaatcacgacgaaaaggaaaattcagaaaatagaggcatctttatggaactgttcaatgttagccgaattagacaacgacttcggttcatattcaaagttccaaatctttaaaagcatgtacctcaaaacaacacaaaatgaactccttcagtgcatcttaaatgtttatcacgaggaaataaggaaagaaattgaaaattatctttgtgttgcagtgattgccgatgaaacgacagacgtcgcgtcgctggtgaatttcagttagttatagttttccgatatttgtgtaaagggcgataagttgagagattttggagattttacttgttggacggacatgatgtcaaatcaatcactg

SEQ ID NO: 543 - DNA, 999 bp, Diabrotica virgifera
catacataccacagcgaagcgtttcctgaacctcgatgtgcgaggtttgtgtttaatttatcctttggcgctgtagaagtttattacacgcatgcattaagaaaagtacctccaattaagattaagaatttaagcaagttttaagaatttaggcaagttatctccacagcactaaagaaattaagaaaaataaagtcagagtgtttgtctcaattgtatcaagtttagaagagcgaggataatggatctcgtcatgtccttttatacccactcaagactgtacaaaaagacaagcactctagacaatcaattcaagacaagtactcatcttaacgcagtcaagaagtttgtttgtagatataagtacattttttttgttaagtttccattctaaatggtgggccagttttgtcaagtttagaaacaagatttgggcaagaggttcgtaagagggaagaatagaagaaagcaactaatacagtttgtagcattttagaaaaaaaaattagaagataacttgaaaacggagactaaactttaatgaactatcaagtttattatcattaacaccttttattctcggtaacaagtatgtaaaagcaaatattatttatggagtagaaaaaataatgtttgttccacttctgtcaagaagacagaatgaaattcaagctggttaaattaaataaaagattctcttgtctaatgaattgcattgaagatatcttcacctgattgtcacatgcctgtcgaaaatatctagctatatcagaataataaggactttcataaattacgaaaaattaacgaagcaaagaaaactgtttgaaaatcaattaagaaacattcggaaaggccaatattttgtttttttgtgtttacataaaatctaaagatatataaatattacatttatatgtacggatttaagaaaatgaaacctggtattcaatatgtaattccgaaaaatatcacatagaaataaaatttattatacat

SEQ ID NO: 544 - DNA, 26 bp, Diabrotica virgifera
catacataccacagcgaagcgtttcc

SEQ ID NO: 545 - DNA, 24 bp, Diabrotica virgifera
cgacaggcatgtgacaatcaggtg

SEQ ID NO: 546 - DNA, 508 bp, Diabrotica virgifera
catacataccacagcgaagcgtttcctgaacctcgatgtgcgaggtttgtgtttaatttatcctttggcgctgtagaagtttattacacgcatgcattaagaaaagtacctccaattaagattaagaatttaagcaagttttaagaatttagggccagttttgtcaagtttagaaacaagatttgggcaagaggttcgtaagagggaagaatagaagaaagcaactaatacagtttgtagcattttagaaaaaaaaattagaagataacttgaaaacggagactaaactttaatggaagaactatcaagtttattatcattaacaccttttattctcggtaacaagtatgtaaaagcaaatattatttatggagtagaaaaaataatgtttgttccacttctgtcaagaagacagaatgaaattcaagccggttaaattaaataaaagattctcttgtctaatgaattgcattgaagatatcttcacctgattgtcacatgcctgtcg

SEQ ID NO: 547 - DNA, 969 bp, Diabrotica virgifera
ttgactacaaatgaaaaaaaactcttattaactactttactttcagattggaaaatactgacaaaatacaattaaaacattgtattctttcaaaatggttaccaatctagaggtaaaaaagtgcataataatagtttattttaaaatttgcagtttattttcaagagattttcaaaaaatgattttttctttactgtacactcctgtattagaagtagaaatcagcgagtgttaattacttcgttctaaataattatttttgttgaagatttaattcttactgattctattgtctatctcaaataatatctgtttaatgaagtattatgaatagttgtacttttttagttaatatttaataacttcactatccaatcaactatataattcaagaaccttaatgtgtccctaatatgtatgtccatgaatcaaatgtgattcaaggatagaagctattctaaaattaaaatagtattggacatagactcctgattatgttaacattgggtcagtggagttatcaatatcactaagaaatggcacatttagaaaaaaactaaaggtaattagttttcaaatcgtacaattattgttctcaaaacataaaacagcattctaatattctttacctattaatactctattctgttttcaattgttttaaatccataaataaacagctgtcaaacaatcataacattctacaaccaagaaaccatgaaatgtccatgccacattaatattgaaacaaattttttggtttatgttacaacaaacagtcattttagtatattaaatcacctaaagtatatgacttaatatatcaaaacaacaatttgtctgaggacatgtgaatatcctagaagcaactttttaaaccaaacaaattaataagattaactatataaatgcagcatttatatttgatggtttctagtatcaatgacatccaaaatacaaacaagtgtt

SEQ ID NO: 548 - DNA, 34 bp, Diabrotica virgifera
gtacactcctgtattagaagtagaaatcagcgag

SEQ ID NO: 549 - DNA, 37 bp, Diabrotica virgifera
gatgtcattgatactagaaaccatcaaatataaatgc

SEQ ID NO: 550 - DNA, 754 bp, Diabrotica virgifera
gtacactcctgtattagaagtagaaatcagcgagtgttaattacttcgttctaaataattatttttgttgaagatttaattcttactgattctattgtctatctcaaataatatctgtttaatgaagtattatgaatagttgtacttttttagttaatatttaataacttcactatccaatcaactatataattcaagaaccttaatgtgtccctaatatgtatgtccatgaatcaaatgtgattcaaggatagaagctattctaaaattaaaatagtattggacatagactcctgattatgttaacattgggtcagtggagttatcaatatcactaagaaatggcacatttagaaaaaaactaaaggtaattagttttcaaatcgtacaattattgttctcaaaacataagacagcattctaatattctttacctattaatactctattctgttttcaattgttttaaatccataaataaacagctgtcaaacaatcataacattctacaaccaagaaaccatgaaatgtccatgccacattaatattgaaacaaattttttggtttatgttacaacaaacagtcattttagtatattaaatcacctaaagtatatgacttaatatatcaaaacaacaatttgtctgaggacatgtgaatatcctagaagcaactttttaaaccaaacaaattaataagattaactatataaatgcagcatttatatttgatggtttctagtatcatgacatc

SEQ ID NO: 551 - DNA, 926 bp, Diabrotica virgifera
gtaagatataagagaataacacaatttgataatatatttcttcggttaccattcgtacttaaatatacactcgttctaatattatttttcacctaacctttactaacttctatatctagatccttatccgtcaaatacggcaacttaaccttttcgtggagggaaataaccgtagtcgctaacacttttcggtgcccggtagatggttaaatacaaagaggactcgtttaggtaccgttaattatcgtaaataccagtaaatgattcatttaggattaaaattacttgctaaagtaagctgagtaagttttatcggtgataatattacagccttctagtttgtcaacgatacgccatctaggttttcaaagatatattccaggacccggtataaaaccgtgggagaaataatacccaccttgatgtattcctcgatttacggtgttttgtctgcatctatccagacttcatccaaataccatcactttcatgtatgtacttgataaggctcgaatgcctggagtcaaatcttgcttaatccagggccttacaaattgaccaaatttccaagacttttcggttctacaaatttaatctacacaattaagtgtatggatacattgtattctgcgtaatatttctttattacagttcttattgcataaaggtggttagtaatatttaacgcgtttcaaaaacccgcctgttcgacagtgaagagtgatcaattcaaatagcacagacctataagtgatgtattggcaaccgtaaactatatttgttataatcaaatcaataattttataagctaaatcagggtagttctcggaagttggctgtataccatttagttaaaaaactttcaacatcaaagtaaaaaaacttctgttgtaatttgtgaagtattaaattaaaaatccaaacgg

SEQ ID NO: 552 - DNA, 34 bp, Diabrotica virgifera
cttcggttaccattcgtacttaaatatacactcg

SEQ ID NO: 553 - DNA, 28 bp, Diabrotica virgifera
ggtatacagccaacttccgagaactacc

SEQ ID NO: 554 - DNA, 804 bp, Diabrotica virgifera
cttcggttaccattcgtacttaaatatacactgttctaatattatttttcacctaacctttactaacttctatatctagatccttatctgtcaaatatggcaacttaaccttttcgtggagggaaataaccgtagtcgctaacacttttggtgcccggtagatggttaaatacaaagaggacttgtttaggtaccgttaattatcgtaaataccagtaaatgattcatttaggattaaaattacttgctaaagtaagctgagtaagttttatcggtgataatattacagccttctagtttgtcaacgatacgccatctaggttttcaaagatatattccaggacccggtataaaaccgtgggagaaataatacccaccttgatgtattcctcgatttacggtgttttgtctgcatctatccagacttcatccaaataccatcactttcatgtatgtacttgataaggctcgaatgcctggagtcaaatcttgcttaatccagggccttacaaattgaccaaatttccaagacttttcggttctacaaatttaatctacacaattaagtgtatggatacattgtattctgcgtaatatttctttattacagttcttattgcataaaggtggttagtaatatttaacgcgtttcaaaaacccgcctgttcgacagtgaagagtgatcaattcaaatagcacagacctataagtgaagtattggcaaccgtaaactatatttgttataatcaaatcaataattttataagctaaattagggtagttctcggaagttggctgtatacc

SEQ ID NO: 555 - DNA, 904 bp, Diabrotica virgifera
gcaaaagttaaacttttgaactattttgatctatcgtcaatgtttgcagaaaatatttgattaaatacaattgaaaaaacaatggaacatcatagaaacttgatgaagacttacaagaacaacaagtactcggtcaaataaacattttggaaagtttacctttttaaaatagttggactttttttctgaactcctgccaggctctcgataatcttagaataatgggttgttttatgtatacttgtttattggctgaggtatttaatatctagattaagattccaatcaaagtttttggcctaggtgaactgtagttttatagaaaaatctcaaacgcatttagttgcgtttataaatgtctactacctaattgtatagaacgcacaggttatattttacagatttctcgactttttgacttctatccgtgatgatttgacgtgagaggcgtccaaagtctcttttgaaaatttgtaaatgtgttaaggtgctttgagttcgaaagttagctgtcttttcgaagcattaatttgtcaaaaacatagttatagtataaaccaataagcgcttacctcaggaatatttgtcttgtagaggtaaaatgaagagttatatttttattgttcgtcagagataaaagattttgttttgtgagaatatcgctaaatattatatttttgatacattaataaatatacagattgggcaagctagtttttgaataacatattgacatttatttatcggattcactgtgttcagaagagcctttggaaatttagattagggtgcaagtatattaaagatgataagagattgatacatatcatactatacatatcatattaactatatcgatgttattctatattataaaattaatatttaataaatgtctaccagc

SEQ ID NO: 556 - DNA, 36 bp, Diabrotica virgifera
catagaaacttgatgaagacttacaagaacaacaag

SEQ ID NO: 557 - DNA, 36 bp, Diabrotica virgifera
tctcttatcatctttaatatacttgcaccctaatct

SEQ ID NO: 558 - DNA, 725 bp, Diabrotica virgifera
catagaaacttgatgaagacttacaagaacaacaagtgctggtcaaataaacattttggaaagtttacctttttaaaatagttggactttttttctgaactcctgccaggctctcgataatcttagaataatgggttgttttatgtatacttgtttattggctgaggtatttaatatctagattaagattccaatcaaagtttttggcctaggtgaactgtagttttatagaaaaatctcaaacgcatttagttgcgtttataaatgtctactacctaattgtatagaacgcacaggttatattttacagatttctcgactttttgacttctatctgtgatgatttgacgtgagaggcgtccaaagtctcttttgaaaatttgtaaatgtgttaaggtgctttgagttcgaaagttagctgtcttttcgaagcattaatttgtcaaaaacatagttatagtataaaccaataagcgcttacctcaggaatatttgtcttgtagaggtaaaatgaagagttatatttttattgttcgtcagagataaaagattttgttttgtgagaatatcgctaaatattatatttttgatacattaataaatatacagattgggcaagctagtttttgaataacatattgacatttatttatcggattcactgtgttcagaagagcctttggaaatttagattagggtgcaagtatattaaagatgataagaga

SEQ ID NO: 559 - DNA, 874 bp, Diabrotica virgifera
taataaataaatctactttaaaatgtacatataatatattatatctgaattgtcaatatgaatgagtgagataaaattaaattattagagaaaaattttttaccaagcatcaaaaacaaaatttgattaaattattaaagttttgtattttgataatgatttccaagttggaaattgaaacgtcaaataaatttaatttaaaacttaaactgtggcttgatcccctgtcacaagaaaaaaaaacacaccacgtctacgtctatgcagataaggacacctgttaacgagtaaaatatttcttggattctcaccctgccttggacgtaaatatatagaccagcgaagtattgataaggttaccaatgattcacagtgttcaaggaatttgttcaacttagccgcccgtaaatatgacccatagaccggaggtatattgttaccgaggcaaattttatgaaatcatcttcctttttcccttatgcacattggcaaggcatacccaataaaaatgaccccggtataaatttagttttaaaatttaacattgttgctgttctcagttcaatttgtagatgagtcgccttcaattaaaaatggttggagagagaacaaatgattgagtaaattagtaaaaaaacattaattagtagtcatcttaattataaatcaaattaataataaaaatatcccaactaaaatattttactaaacgtcataccgttggtcatactaaacgtcatacatatttatacctaattatgacagaagtcaacaagcacttaagataacgtctaaatgtgagaaactactatgtaatgtaaatgtataggtgtctaacgacaattttccacctctacaagtttgatctcttttt

SEQ ID NO: 560 - DNA, 24 bp, Diabrotica virgifera
tgtggcttgatcccctgtcacaag

SEQ ID NO: 561 - DNA, 32 bp, Diabrotica virgifera
gagatcaaacttgtagaggtggaaaattgtcg

SEQ ID NO: 562 - DNA, 658 bp, Diabrotica virgifera
tgtggcttgatcccctgtcacaagaaaaaaaaacacaccacgtctacgtctatgcagataaggacacctgttaacgagtaaaatatttcttggattctcaccctgccttggacgtaaatatatagaccagcgaagtattgataaggttaccaatgattcacagtgttcaaggaatttgttcaacttagccgcccgtaaatatgacccatagaccggaggtatattgttaccgaggcaaattttatgaaatcatcttcctctttcccttatgcacattggcaaggcatacccaataaaaatgaccccggtataaatttagttttaaaatttaacattgttgctgttctcagttcaatttgtagatgagtcgccttcattaaaaatggttggagagagaacaaatgattgagtaaattagtaaaaaaacattaattagtagtcatcttaattataaatcaaactaataataaaaatatcccaactaaaatattttactaaacgtcataccgttggtcatactaaacgtcatacatatttatacctaattatgacagaagtcaacaagcacttaagataacgtctaaatgtgagaaactactatgtaatgtaaatttataggtgtctaacgacaattttccacctctacaagtttgatctc

SEQ ID NO: 563 - DNA, 849 bp, Diabrotica virgifera
  modified_base (765): n = a, c, g or t/u
cttaaaatgtataaatttacctgattataaaacctttttttatttcttaacaaataaacattcagtggaccaaaggatacatatcgatacctcagagcaacagtgagataagtggaaaatttcagtttttttaagtctgcttatttacatagaatgtgttgccagtgtggagtgcagtgcattctatgtaaatggcgtacttaaacaaggttgaggttttggacttctcactgttgctttgatgtatcgatataagctacatagtagatacatagaggaaatcttgtgctttattcttttttagaatttcaatggttaatatattagatattaaaataatgacccaaaaaatctatatagtgctatctaaatattgctgctgcaagaatttttttattagttctttaacccagttttatgaccttcatgtacatatatccaaatctatattgccagggtattggaaataataccctggatttttagcctgaagtatattaccaatgatgtacacaaactactagtctaaagaaacaccgactattgaagaatattaagaagctacaggttacttttcatttttccaaaatatcatttgtatttttcagttctattctgtcacaactaaattttattccactttaccacgagagtaatctgttttttcgtaactaaaagaggatcgatgggtagccaagaagttgagaaacagtaagatttcaaatattgcaaaacgttgcaaatatttttaagaatgtattttanaatgttaaatggatacatgaactaatcagaaagcagtcttcaaaaaagaaaaagcagtgttaagacacagtattcgaaaacatc

SEQ ID NO: 564 - DNA, 28 bp, Diabrotica virgifera
cattcagtggaccaaaggatacatatcg

SEQ ID NO: 565 - DNA, 35 bp, Diabrotica virgifera
gactgctttctgattagttcatgtatccatttaac

SEQ ID NO: 566 - DNA, 655 bp, Diabrotica virgifera
cattcagtggaccaaggatacatatcgatacattctatgtaaatagcgtacttaaacaaaattgaaattttggacttctcactgttgctttgatgtatcgatataagctacatagtagatacatagaggaaatcttgtgctttattcttttttagaatttcaatggttaatatattagatattaaaataatgacccaaaaaatctatatagtgctatctaaatattgctgctgcaagaatttttttattagttctttaacccagttttatgaccttcatgtacatatatcccaaatctatattgccagggtattggaaataataccctggatttttagcatgaagtatattaccaatgatgtacacaaactactagtctaaagaaacaccgactattgaagaatattaagaagctacaggttacttttcatttttccaaaatatcatttgtatttttcagttctattctgtcacaactaaattttattccactttaccacgagagtaatctgttttttcgtaactaaaagaggatcgatgggtagccaagaagttaagaaacagtaagatttcaaatattgcaaaacgctgcaaatatttttaagaatgtattttaaaatgttaaatggatacatgaactaatcagaaagcagtc

SEQ ID NO: 567 - DNA, 848 bp, Diabrotica virgifera
cggacgcgtgggtaatgatcttaacgtttatagtactatatagagaattgaataacctttcaaatgagccggcacacgacatccgttctcatttataaagaaaaaatcgattacgtcatcacgcccagatggatcgccgtcaccggtgcgatatatgtgtcaagggtcataattggaaagtcgaacttttgtattttacattttttttctagttctgtaaataaggcagtttgcaggggggtcaaaatatggtgaatagccctgtacattcattggggccgaccgatcggctctgtcccgtcatgcagctgaccgactgtaataacttttatttatattcaatttggaatgtgtgtactgattttcaaccttagtaaatggatttaattaccttcgtaggaaagcaactttgataccctcttagtaaccactggttctacgtttcgtttgaccgaccgcagtatgtttctctacctacacaatcacagtgatcaattatgaaaagtttagcttttgtgaattcacagattttttagcgctttatattggaaaattaacatttttcaatataaaccgtccactatattaatagatacaaaattaggagctgtagcagaaaagtatctcaactgactcaatttattttattaataagtcctggtatttattacgtttgaaaacggacattttggatgctttctatcttcgatctttgtaaagaaaccgtggaataaagtaaaacaatgttaaatattacctaggtattttaatgcataaaattatatactcaatgcttgaaggataatataaagaagcatttgttttttttttaatattttttctcttcg

SEQ ID NO: 568 - DNA, 24 bp, Diabrotica virgifera
cgattacgtcatcacgcccagatg

SEQ ID NO: 569 - DNA, 31 bp, Diabrotica virgifera
ctttacaaagatcgaagatagaaagcatcca

SEQ ID NO: 570 - DNA, 610 bp, Diabrotica virgifera
cgattacgtcatcacgcccagatggatgccgtcaccagtacgatatatatgtcagggatcataattggaaaatcgaacctttgtattttgcattttttttctgattctgtaaataaagcggtttacaagggggtcaaaatatggtgaatggccctgtacattcattggggccgaccgatcggctctgtcccgtcatacagctgaccgactgtaataacttttatttatattcgatttagaatgtgtgtactgattttcaaccttagtaaatggatttaattaccttcgtaggaaagcaactttgttaccctcttagtaaccactgttctacgtttcgtttgaccgaccgcagtatgtttctctacctgcacagtcacagtaatcaattgtgaaaagtttagcttttgtaaattcacagattttttagcgctttatattggaaaattaacatttttcaatataaaccgtccactatattaatagatacaaaattaggagctgtagcagaaaagtatctcaactgactcaatttattttattaataagtcctggtatttattacgtttgaaaacggacattttggatgctttctatcttcgatcttgtaaag

SEQ ID NO: 571 - DNA, 828 bp, Diabrotica virgifera
gacaataatcgtgtagatggcgctaagattataatagattatttataattagatattacggaacattaaaaaaaacttaaattcagtatttaaaacgtaagtatatttaaggtaaaaatatataccacagctttgaccaactaatattgtttataattaatgtttttaattttaattttaaattaatcactttgacatttatgtcaaatttccgataaacgtttacaaacttgtcactactgcgttcgcgaatttgtaaatatcccctctacgtacgagctcacagcgtatacgctgtgtgcttcgctggtgtcgttcctagcggactactattcaactttcaccggtaatttttaaatttattatttaattgttatcgcttaatatttacaacgcaaaaaagtaattaaattgtaatggattttttaagattttgctaatcattttgacgttctattgacaaaatatgaatttcttacttcggatactttcacaattatcgtgtagatggcgctaagattaatggattaatagattaatagaacattaaaaaaacttaaattcagtatttaaaacgtaagcatatttaaggtaaaaatatataccacagctttgactaactaatattttttataattaatgtttttaattttaattttaaattaatcactttgacatttatgtcaaatttccggtaaaggtttacagacttgtcactaatggcgttcgcgaatttgtaaatatcccctctacgtacgagctcacagcgtataactgaacgacaacgaacgaacgaacacgaacactgaacacagattcacagatagc

SEQ ID NO: 572 - DNA, 29 bp, Diabrotica virgifera
cgtttacaaacttgtcactactgcgttcg

SEQ ID NO: 573 - DNA, 29 bp, Diabrotica virgifera
gctatctgtgaatctgtgttcagtgttcg

SEQ ID NO: 574 - DNA, 609 bp, Diabrotica virgifera
cgtttacaaacttgtcactactgcgttcgcgaatttgtaaatatcccctctacgtacgagctcacagcgtatacgctgtgtgcttcgctggtgtcgttcctagcggactactattcaactttcaccggtaatttttaaatttattatttaattgttatcgcttaatatttacaacgcaaaaaagtaattaaattgtaatggattttttaagattttgctaatcattttgacgtcctattgacaaaatatgaatttcttacttcggatactttcacaattatcgtgtagatggcgctaagattaatggattaatagattaatagaacattaaaaaaacttaaattcagtatttaaaacgtaagcatatttaaggtaaaaatatataccacagctttgactaactaatattttttataattaatgtttttaattttaattttaaattaatcactttgacatttatgtcaaatttccggtaaaggtttacagacttgtcactaatggcgttcgcgaatttgtaaatatcccctctacgtacgagctcacagcgtataactgaacgacaacgaacgaacgaacacgaacactgaacacagattcacagatagc

SEQ ID NO: 575 - DNA, 824 bp, Diabrotica virgifera
  modified_base (785): n = a, c, g or t/u
gcgatgcgataccgacaaagctccctttgactcggacgcgccagaccgacagagaacggaagtagagcgaagcgaggcaaagttgcacaaggtgtccgtctacactctcgtacttgttgaacctcgatcgacttcggcgagagtgtggagctcacataacattttttcatagagagtaataatgtaacagtttgtagtttctaccagttgtgatgtaacaggcgtaacgctatgttatttcacaatatggagaagatctactacttcttcatttgtgacgagatctaccagcgaaatttcaaaaattgtcctcgagatggacatttcaaacttttttaggttctatgatcttaatttaacttccatcaacaataagatttactgtttttgattaaatagttaatctagcaaagatagaccagcaggtacttccttaaatctagtaatggtcagcgtttacatagaccaataatagtttattaagcttttttcggtcaactttttaagtcttgtttttaaaggaatgtttgtataacattttaaacctttgtaaaacatgtaccattaatgttgcccttctactcctttataaaaataattgttaaaataacttataaaattaatcttgtttaatgactcgaaatataaattttaattttcgtataaggttcagatttacagtattagttatattataatttacagaaatttttcaatttcttttctaataactacacatacagcaaaaagtatgcctggtggtaacgttcattaaattaagaagnttgtcgttgcttgaaacttgtgaaaattttgatagtttt

SEQ ID NO: 576 - DNA, 23 bp, Diabrotica virgifera
cgatgcgataccgacaaagctcc

SEQ ID NO: 577 - DNA, 27 bp, Diabrotica virgifera
cacaagtttcaagcaacgacaatcttc

SEQ ID NO: 578 - DNA, 804 bp, Diabrotica virgifera
  modified_base (27)  (165): n = a, c, g or t/u
cgatgcgataccgacaaagctcccttngactcggacgcgccagaccgacagagaacggaagtagagcgaagcgaggcaaagttgcacaaggtgtccgtctacactctcgtacttgttgaacctcgatcgacttcggcgagagtgtggagctcacataacattttntcatagagagtaataatgtaacagtttgtagtttctaccagttgtgatgtaacaggcgtaacgctatgttatttcacaatatggagaagatctactacttcttcatttgtgacgagatctaccagcgaaatttcaaaaattgtcctcgagatggacatttcaaacttttttaggttctatgatcttaatttaacttccatcaacaataagatttactgtttttgattaaatagttaatctagcaaagatagaccagcaggtacttccttaaatctagtaatggtcagcgtttacatagaccaataatagtttattaagcttttttcggtcaactttttaagtcttgtttttaaaggaatgtttgtataacattttaaacctttgtaaaacatgtaccattaatgttgcccttctactcctttataaaaataattgttaaaataacttataaaattaatcttgtttaatgactcgaaatataaattttaattttcgtataaggttcagatttacagtattagttatattataatttacagaaatttttcaatttcttttctaataactacacatacagcaaaaagtatgcctgtggtaacgttcataaattaagaagattgtcgttgcttgaaacttgtg

SEQ ID NO: 579 - DNA, 812 bp, Diabrotica virgifera
cggagacgagtcatttgcggacatgtgtttgtcgagcaaaccggcattattttttcatgtagaattgccctttaaagtttttcatacttatttactaacaccctgtatgtgtcgacaacacatgtacaagtatgcatgcacaatgcgccattttaaacttgaacatcagtagttgaagcatccagtatcgtatgtctacacgaatggtcaaaactcaactgtattaaactttgtacaagtctttcacacacacactctcaattacacttgcgtaaaaaattaacaagtaaaaattacaaaatgttcacaagtctcttgccacttgtacagttaacgtacttgtgctagcattacccaacacccgttccagtatacttgtgcaataaacttgtgcatgggaacacgttgggaagaaaaatgtgtaaggttaggtcgaacacgttgaccattcgcaaaattaaattccaacagagggcgctcaaaatttcaaagatggacgacaactctaggaaaacaattcattttgtcatttgaattcacagttctaaaacgttacattaaaatcatttacaggagtgttttgccaaagtaaccactaagttttgcaactaagacatcttataagttaaagacgactcaaaattatgtttaaactgtatgcattcattaaaatttgatgctaactactgatttgtttttacctttttttcataaaaaaatctggcccccgataatcacacagcgttctaaaaattattaatctatcttaggatttctaattttgtttttaatttaattaataggtgcactac

SEQ ID NO: 580 - DNA, 24 bp, Diabrotica virgifera
ggagacgagtcatttgcggacatg

SEQ ID NO: 581 - DNA, 30 bp, Diabrotica virgifera
cttagtggttactttggcaaaacactcctg

SEQ ID NO: 582 - DNA, 599 bp, Diabrotica virgifera
ggagacgagtcatttgcggacatgtgtttgtcgagcaaaccggcattgttttttcatgtagaattaccctttaaagtttttcatacttgtttgctaacaccccgtatgtgtcgacaacacatgtacaagtatgcatgcacaatgcgccattttaaacttgaacatcagtagttgaagcatccagtatcgtatgtctacacgaatggtcaaaactcaactgtattaaactttgtacaagtctttcacacacacactctcaattacacttgcgtaaaaaattaacaagtaaaaattacaaaatgttcacaagtctcttgccacttgtacagttaacgtacttgtgctagcattacccaacacccgttccagtatacttgtgcaataaacttgtgcatgggaacacgttgggaagaaaaatgtgtaaggttaggtcgaacacgttgaccattcgcaaaattaaattccaacagagggcgctcaaaatttcaaagatggacgacaactctaggaaaacaattcattttgtcatttgaattcacagttctaaaacgttacattaaaatcatttacaggagtgttttgccaaagtaaccactaag

SEQ ID NO: 583 - DNA, 802 bp, Diabrotica virgifera
cgtggcgtttttctatttacagtatgtgaatgtgtcaaagtaactgtgtttttcaaaaattaacaaaagaaattcaaaatgtacaagtggacaaaaaatattaaacaaatgtatatagtgtatctatttctaatcgaatcaacaaaatatgatcttactgaacagaatatgatgcaagctaatattaaatgcaactcgtatgttttattatatcctaaaccaaagacttattcatcttgaaggtgactgtgtgccgtcatctcttttattgagacaattaggacgtttttcgttctcagcggcttctcggaaatccctggcttacagaaacggatggtgactatagtcacggaactgtcaaaattaattttgtatcttatatgaagcctcaaacgttttggaaatatttcttctctttatcaggaactggaaagaagtatatgccctcagtttgttatctttctctagatgatgggaggaaaaatttttaaaatacctgtttgtcagagttttattactattaagaagaattcttcatcttaaaggtaaccgggtgtcgtcatcacttttattgacacaattaggacgttttttgatctcaatggcttttggtgtggacaatagttatagaactttcaaaaccaattttgtgtcctgtctagatcatcaaacggttttgagaagatttcttcccttcatatggagctggaaagaagtatttgacacctgttagttatctttctctagatgatggaaagaaaatctttttgaaagctatacagaagtcttaaaatacctgttt

SEQ ID NO: 584 - DNA, 33 bp, Diabrotica virgifera
gtggcgtttttctatttacagtatgtgaatgtg

SEQ ID NO: 585 - DNA, 35 bp, Diabrotica virgifera
gataactaacaggtgtcaaatacttctttccagct

SEQ ID NO: 586 - DNA, 737 bp, Diabrotica virgifera
gtggcgtttttctatttacagtatgtgaatgtgtcaaagtaactgtgtttttcaaaaattaacaaaagaaattcaaaatgtacaagtggacaaaaaatattaaacaaatgtatatagtgtatctatttctaatcgaatcaacaaaatatgatcttactgaacagaatatgatgcaagctaatattaaatgcaactcgtatgttttattatatcctaaaccaaagacttattcatcttgaaggtgactgtgtgccgtcatctcttttattgagacaattaggacgtttttcgttctcagcggcttctcggaaatccctggcttacagaaacggatggtgactatagtcacggaactgtcaaaattaattttgtatcttatatgaagcctcaaacgttttggaaatatttcttctctttatcaggaactggaaagaagtatatgccctcagtttgttatctttctctagatgatgggaggaaaaatttttaaaatacctgtttgtcagagttttattactattaagaagaattcttcatcttaaaggtaaccgggtgtcgtcatcacttttattgacacaattaggacgttttttgatctcaatggcttttggtgtggacaatagttatagaactttcaaaaccaattttgtgtcctgtctagatcatcaaacggttttgagaagatttcttcccttcatatggagctggaaagaagtatttgacacctgttagttatc

SEQ ID NO: 587 - DNA, 778 bp, Diabrotica virgifera
tcaaaaaattcatgaaagtcagatgacgataaccaaggagctgtcatgcgtctgcgcgaagaactaaaatgtttgacgcgccgtcaccaaaatggaacatggagaacaaaggattttcgcggagtgaccctactgattatttagcattatactaatctcaaatacattaggtttgttctagcatcagtttcaagcggtttgaaatcatcagaagcatgcgcatttgtttgatggcgtttaagcacacaaattactagtttgaaactactagtccagcgttctaactttgatttggaaactagctttaaacggtcaaaagggtttgcggattttgttctgagtcaatttgtgacttgcgaggtggaattattgtttgaggtttataaattttaaatgaaaatgatatgttttgactgtttgttacttaccattatttacgtttataacattaattttctcacaatggagcactgaggaacgtttgtttttctatacttccacaaaattttgtggaagtatggaaaaacaaacgtttttcagtgttttattgtgagataaaatgaacttccatcaagtaacggtcgaatccatcaattacattgattttcaatatttaacgtaaatcttgaaaatttggataacacaagaaaaatatatttctaatctaacctcaaaattataaataaaaacaaacatgaaccagtctcatttgacgttagtattttctccgaaaaaaaagcgttctagcaaaaaacagtttgctaccagtttgtggatt

SEQ ID NO: 588 - DNA, 30 bp, Diabrotica virgifera
catgaaagtcagatgacgataaccaaggag

SEQ ID NO: 589 - DNA, 30 bp, Diabrotica virgifera
ctaacgtcaaatgagactggttcatgtttg

SEQ ID NO: 590 - DNA, 709 bp, Diabrotica virgifera
catgaaagtcagatgacgataaccaaggagctgtcatgcgtctgcgcgaagaactaaaatgtttgacgcgccgtcaccaaaatggaacatggagaacaaaggattttcgcggagtgaccctactgattatttagcattatactaatctcaaatacattaggtttgttctagcatcagtttcaagcggtttgaaatcatcagaagcatgcgcatttgtttgatggcgtttaagcacacaaattactagtttgaaactactagtccagcgttctaactttgatttggaaactagctttaaacggtcaaaagggtttgcggattttgttctgagtcaatttgtgacttgcgaggtggaattattgtttgaggtttataaattttaaatgaaaatgatatgttttgactgtttgttacttaccattatttacgtttataacattaattttctcacaataaagcgctgaagggcgtttgtttttctatacttccacaaaattttgtggaagtatggaaaagcaagcgtttttcagtgttttattgtgagataaaatgaacttccatcaagtaacggtcgaatccatcaattacattgattttcaatatttaacgtaaatcttgaaaatttggataacacaagaaaaatatatttctaatctaacctcaaaattataaataaaaacaaacatgaaccagtctcatttgacgttag

SEQ ID NO: 591 - DNA, 765 bp, Diabrotica virgifera
gacaatttggaatttaattctttggaatcgttgtcagtggactttcataattttttacataatttaattttacggtagaataattttttcaacgttactgtttagtgctggcctttaaacgaatgtgattctagatgatagttgttaaatgatcgtcaagtcgaatagtggtgatctctgagagtctcctgaagtagtaaggcagataaatgaatagctgtgagtttgttgaaataagtgtcctgacggaggctcatcacgtaaagcattgtaagttatattgttctacttatattccaagagtcaccgttgcatgccggaacgagaaatagattcagtttattgagaggagaaaaggctagcatggttttttgaacgatacgtgcatctgaagggggtcattgatgacaataggcttgcaatagtttgttgcgagattgctgactacatagggggctgctaagagtaaattgtaggcgaccagagacaagaatttggacaactcatcatccgagagacagttttattttttttgtagaattattcataacgcaaatttcaataagtactttagatagtggtaggagtatttcaataatcagaataggagatattatttttagaggatattttgagggtgaatttatttcaatagatgtttttgtaccatatatgtgttttattccgttagtctttgaccttatttatcatatgtaaagcaaaggagatattgaagcacgagaatataaaaccctgagattagag

SEQ ID NO: 592 - DNA, 27 bp, Diabrotica virgifera
ctttggaatcgttgtcagtggactttc

SEQ ID NO: 593 - DNA, 29 bp, Diabrotica virgifera
ctcgtgcttcaatatctcctttgctttac

SEQ ID NO: 594 - DNA, 726 bp, Diabrotica virgifera
ctttggaatcgttgtcagtggactttcataattttttacataatttaattttacggtagaataattttttcaacgttactgtttagtgctggcctttaaacgaatgtgattctagacgatagttgttaaatgatcgtcaagtcgaatagtggtggtctctgagagtctcctgaagtagtaaggcagataaatgaatagctgtgagtttgttgaaataagtttcctgacggaggctcatcacgtaaagcattgtaagttatattgttctacttatattccaagagtcaccgttgcatgccggaacgagaaatagattcagtttattgagaggagaaaaggctagcattgttttttgaaagatacgtgcatctgtagggggtcattgatgacaataggcttgcaatagtttgttgcgagattgctgactacatagggggctgctaagagtaaattgtaggcgaccagagacaagaatttggacaactcatcatccgagagacagttttatttttttttttgtagaattattcataacgcaaatttcaataagtactttagatagtggtaggagtatttcaataatcagaataggagatattatttttagaggatattttgagggtgaatttatttcaatagatgtttttgtaccatatatgtgttttattccgttagtctttgaccttatttatcatatgtaaagcaaaggagatattgaagcacgag

SEQ ID NO: 595 - DNA, 735 bp, Diabrotica virgifera
ttattttagcacacaaacaaaatgctcggtgttagtatattatagcatcaatgtttcgaattttgcacgatccctcttcaggtgattcgaaaaacatgaatgcgtttaaaaataattcgatcgaaattttgcgcctacgctctcaaaaaaggttaaagtattatacatttttgtaatcagtatttcaattgcttttaaatcagctgtcatatgatgtacttttccattttaaaaaaattaaagttgtgcctgtcacctgaagagggatcgcatgaagttcgaaacattgatgttataatacactttgatcattttaaaaatcgacctgtccgagcgttttgcttatgtgctaaaaataaataagttaatagggggggggggtaacaatcattccagcgcactgtatggtaactacgaggcaagtagaagctgtacctggaatcaacataattagcgtttaagccattttgaagaacaaattccattcatataaaatgtacacctagtacagaaacttaatgagaatgattatgaccgacgtttacagttttgtgaaataattagtgagcgagcagtgagtgatccacagttgcgctttaatattttttctgcggtgaatacactgttctcataaaaaatggaactagtgcaattactggagatggatatgagctattacctccgatttcgttgaacgaaaaatcgtcacaattgccgttattggtctgataaaac

SEQ ID NO: 596 - DNA, 34 bp, Diabrotica virgifera
ctcggtgttagtatattatagcatcaatgtttcg

SEQ ID NO: 597 - DNA, 31 bp, Diabrotica virgifera
gaaatcggaggtaatagctcatatccatctc

SEQ ID NO: 598 - DNA, 662 bp, Diabrotica virgifera
ctcggtgttagtatattatagcatcaatgtttcgaaccccgcacgatccctcttcaggtgactcgaaaaacatgaatgcgtttaaaaataattcgatcgaaattttgcgcctacgctctcaaaaaggttaaagtattatacatttttgtaatcagtatttcaattgcttttaaatcagctgtcatatgatgtacttttccattttaaaaaaattaaagttgtgcctgtcacctgaagagggatcgcatgaagtccgaaacactgatgctacaatacactttgatcactttaaaaatcgacctgtccgagcgttttgcttatgtgctaaaaataaataagccaatagggggggggtaacaattattccagcgcactgtatggtaactacgaggcaagtagaagctgtacctggaatcaacataattagcgcttaagccattttgaagaacaaattccattcatataaaatgtacacctagtacagaaacttaatgagaatgattatgaccgacgtttacagttttgtgaaataattagtgagcgagcagtgagtgatccacagttgcgctttaatattttttctgcggtgaatacactgttctcataaaaaatggaactagtgcaattactggagatggatatgagctattacctccgatttc

SEQ ID NO: 599 - DNA, 711 bp, Diabrotica virgifera
  modified_base (525)  (705): n = a, c, g or t/u
cacactatatttatttgtgaaatgcaagctaacgattgaaaacgatcggtcatacacatatattatgtgtcacataactttggagaggtaaaaaaatactcagaaaaactaaaaataataaaaacaaagaacgtcttttcctcttagttcataaaggagcaaaattaggaaagaaaaccctatcccaccaacacctcttgtaaaaatataaacggttaagacaagcagtggatcttatgtgtcaaattcacgtctattccacgaattttctgtttaagtaaattgtagatctttggttgtatatatagttacttttgtttcatctaaaagttatctacattaaccatataaaatgtttctgaaatgttattgaagaattaagatttcaagaagaatgtctccaactaaaatcgattttggtaaaatcttgttttgttacaagtgtacaaatgtttgatgcaaaatatctattatgaggttgtactaaattgtgagtatatttaaaaataaaaaatactgtatctncttaaanaaccattcaataaaaaaataatttcttaatttcccccaaaaactttaaaattaaattaataactttttcttatatctattatatctncttataataccaccacactcaattttaaaaatcttccaatcattcttttatnaatttttantacaaatataaattttttttttacnaacttt

SEQ ID NO: 600 - DNA, 27 bp, Diabrotica virgifera
gaaatgcaagctaacgattgaaaacga

SEQ ID NO: 601 - DNA, 32 bp, Diabrotica virgifera
cgattttagttggagacattcttcttgaaatc

SEQ ID NO: 602 - DNA, 395 bp, Diabrotica virgifera
gaaatgcaagctaacgattgaaaacgatcggtcatacacatatattatgtgtcacataactttggagaggtgttaggatactcagaaaaactaaaaataataaaaacaaagaacgtcttttcctcttagttcataaaggagcaaaattaggaaagaaaaccctatcccaccaacacctcttgtaaaaatataaacggttaagacaagcagtggatcttatgtgtcaaattcacgtctattccacgaattttctgtttaagtaaattgtagatctttggttgtatatatagttacttttgtttcatctaaaagttatctacattaaccatataaaatgtttctgaaatgttattgaagaattaagatttcaagaagaatgtctccaactaaaatcg

SEQ ID NO: 603 - DNA, 699 bp, Diabrotica virgifera
ccgattttaagaattttcgtctataagttacaacattttaccaaaatactgaaaaagaactgattagtctattgaaataactttaaaatgagttgaagtaaaatagaattggagctttgtttatcaataaacatcaatgaaaggtatacatttgcgatatgccccgtgttggcttaatccgttactgtttaaatttatttcttacgttttaacctaactacctgaggtattagatttaatccatggtttcgaattcacctgtagaaggtttcgagttggcagattcaggtagtagaaaagttacgaattggccggtgttctttgtataccgtagtccctagagataacggactaccctgctttaatcccaaagccgcgatagcgctataaaagggagactattattattatcattttctatgttgcgtttcctttccgaaccataaataccaaaaaaatttgctactttttgttcaatcgtaaatcaatcaatcagtcgtaaatcagaaaattaattaatgccggtacatggacttcaaggattaaagacaatcacaggtaagatatcagtcattgaaagatagtataggagtatagcattgcattctgtggatgaggcaacatatttggggaaatataagtttctttttattcaattgcgaacaatttaagcaacattttagtacaaacttttttctt

SEQ ID NO: 604 - DNA, 26 bp, Diabrotica virgifera
ggtatacatttgcgatatgccccgtg

SEQ ID NO: 605 - DNA, 28 bp, Diabrotica virgifera
ccaaatatgttgcctcatccacagaatg

SEQ ID NO: 606 - DNA, 488 bp, Diabrotica virgifera
ggtatacatttgcgatatgccccgtgttggcttaatccgttactgtttaaatttatttcttacgttttaacctaactacctgaggtattagatttaatccatggtttcgaattcacctgtagaaggtttcgagttggcagattcaggtagtagaaaagttacgaattggccggtgttctttgtataccgtagtccctagagataacggactaccctgctttaatcccaaagccgcgatagcgctataaaagggagactattattattatcattttctatgttgcgtttcctttccgaaccataaataccaaaaaaatttgctactttttgttcaatcgtaaatcaatcaatcagtcgtaaatcagaaaattaattaatgccggtacatggacttcaaggattaaagacaatcacaggtaagatatcagtcattgaaagatagtataggagtatagcattgcattctgtggatgaggcaacatatttgg

SEQ ID NO: 607 - DNA, 688 bp, Diabrotica virgifera
aaagttaacaacaataaacagaataatttaatttgaaccgatttttttagtgcaaacaagtaattggacttcgtaagtcctaggttttcacccaaagtaatcgtcagtagaactgtaattcgatatttgaactcttcgtgtaactttgcgtcgatggatatacgattttactaattttgagtcatttttactaaactttgggttatcattgtcacagaaatgacttcaaaaccggaactaaatattgaaactcaacttttcaatacgcttcgattgatgtgttacatgtactatttctgcgactataatggcacttctggttagaactttttaaccggaaatgatataaaaaccaaaactttatatttgttctcatcttgctaaggcacgtcaaatgatatatcgcttacactatttcggagactttaaaacagtacctatgattgtaactctaaaatcggaagtcagatgtaaagtttctcatctttaataccatccttgggttttaagctttcattcgacacatcatttgtcattctgtctgtattaataacggaggagttttattcgcggacggactgacaaacagtcatgaaacctaaagtatatatttgttctcgactaatatatcacttgcactattccgatgccgttaaaataatacttctggtcgtatttctaaaaccgc

SEQ ID NO: 608 - DNA, 32 bp, Diabrotica virgifera
cgatatttgaactcttcgtgtaactttgcgtc

SEQ ID NO: 609 - DNA, 32 bp, Diabrotica virgifera
ccagaagtattattttaacggcatcggaatag

SEQ ID NO: 610 - DNA, 550 bp, Diabrotica virgifera
cgatatttgaactcttcgtgtaactttgcgtcgatggatatacgattttactaattttgagtcatttttactaaactttgggttatcattgtcacagaaatgacttcaaaaccggaactaaatattgaaactcaacttttcaatacgcttcgattgatgtgttacatgtactatttctgcgactatgatggcacttctggttagaactttttaaccggaaatgatataaaaaccaaaactttatatttgttctcatcttgctaaggcacgtcaaatgatatatcgcttacactatttcggagactttaaaacagtacctatgattgtaactctaaaatcggaagtcagatgtaaagtttctcatctttaataccatccttgggttttaagctttcattcgacacatcatttgtcattctgtctgtattaataacggaggagttttattcgcggacggactgacaaacagtcatgaaaccgaaagtatatatttgttctcgactaatatatcacttgcactattccgatgccgttaaaataatacttctgg

SEQ ID NO: 611 - DNA, 973 bp, Diabrotica virgifera
  modified_base (943): n = a, c, g or t/u
gagcaataaaagaattcgcagtttgagaggaaagtttcaacaccccgtatcttggaaacgaagcatttgcggacatacgtttatagagcaaactgtcattatgtaacaccctgtataggcccacacaaaaaattattacctccttcatgagacttttttttattgagttattcatgtcgggttggacagcgtttctggtgtgaaaaattttcgggagggggacggttcgtaaatatgggggtttataaactttggtgcatctatggtggttcctgtttatctgaaccatctcagatagttaaggggtggttaccccctactataggggttgatgaagtaacactactcacagtatattcatttatttataagttgaagtaactacggtaaagagttggtggctaaatatttatccgctgtgatgtttacccgctgggatctcaaatacccatgattaatctttacgcaatgaatttagaacgtcgaatgtggaatcccctgtttatgttttggtatatataaaaagtgaaagtgtttgtattataaatgctgaatcaacttgattataaataaagaataatatttgctactacagctgaccttgcattatcgataactgatacacttgtatagtaatataggtcaatcatgtttatgataaacaacgcgtattcgtttaccaaggacatttaaatattaaaagaattagtcttgcccttaataagatggttactaagagatgctgtgaatcccaatacacatccgacaactggagtaagtatccttgaaaatttgtcggaaaatattaccagtgaattgtatttttatcaaaatattctgcaaaaaaacccatcatttatgactctatagtggacgcacatatccacgtatagtccccacatatgaggggtgcatcataaagagtaataaattatacccattngtaacattgagttaccaagtgtcaaaaatc

SEQ ID NO: 612 - DNA, 27 bp, Diabrotica virgifera
gcagtttgagaggaaagtttcaacacc

SEQ ID NO: 613 - DNA, 32 bp, Diabrotica virgifera
ggatatgtgcgtccactatagagtcataaatg

SEQ ID NO: 614 - DNA, 867 bp, Diabrotica virgifera
  modified_base (771): n = a, c, g or t/u
gcagtttgagaggaaagtttcaacaccccgtatcttggaaacgaagcatttgcggacatacgtttatagagcaaactgtcattatttaacaccctgtataggcccacacaaaagattattacctccttcatgagacttttttttttattgagttattcatgtcgagttggacgtttctgatatgaaaaattttcaggagggagacggttcgtaaatatgggggtttataaactttggtgcatctatggtggttcctgtttatctgaaccatctcagatagttaaggggtggttaccccctactataggggttgatgaagtaacactactcacagtatattcatttatttataagttgaagtaactacggtaaagagttggtggctaaatatttatccgctgtgatgtttacccgctgggatctcaaatacccatgattaatctttacgcaatgaatttagaacgtcgaatgtggaatcccctgtttatgttttggtatatataaaaagtgaaagtgtttgtattataaatgctgaatcaacttgattataaataaagaataatatttgctactacagctgaccttgcattatcgataactgatacacttgtatagtaatataggtcaatcatgtttatgataaacaacgcgtattcgtttaccaaggacatttaaatattaaaagaattagtcttgcccttaataagatggttactaagagatgctgtgaatcccaatacacatccgacaactggagtaagtatccttganaatttgtcggaaaatattaccagtgaattgtatttttatcaaaatatactgcaaaaaaacccatcatttatgactctatagtggacgcacatatcc

SEQ ID NO: 615 - DNA, 967 bp, Diabrotica virgifera
  modified_base (784)  (895): n = a, c, g or t/u
aatgtgatatttaactagtgatttattttgtatttatcatatgttttataatttaacgaaaacgtatctttagactgtttgcaagagttgttcatccactgcatggacttttgggtaaaagacgtatagcaggttttacaaagcttcggtaattggacacatatttgacattaatcagtcaactgtcatacaacatactcatttttatttcaaggaaataatcttagaataagtattttttgcgtaaacatgttatatgacgtataatagataatatgatgtatattccatagacatatatattattatcatagactgagcctaccctccgcgcttcctggcgacaagatctcttggacaggtttgcggtatctctttctagcacattgtatcgagaaactaacatgaaactgagtgggggtataggcacggaaagggaggactactgtcgcagctttactatgcataagagtgaaacagcactgagccacaaaaaaaaagatggtgtcgtcacttcgcgcaacatgacactctatgataatgtgtgtgtctatggtatatcccagtggacatcctaagtcttgacgtcacaaaattgggagtagcttatatttggctccaggcaattctgtttgtgatgttaagcactcatagggaatttttaatttattgtttatgtggtttgtgtgacaaaataagacttttcatttgggtatttagttggagagacgtgccggttaagagatttttattcgtttttgcccaggtgagttaatttaattanatgattagaatgtaaacagttttgaggttatgtttatttttcatcactaaggaataaaaaacacctgagcnaaaacgaataaaaagtctcctagttgacacgtttctttgncggaatacctaaatggagtcttattttgccgcacaaagcacataaatgaaaaattccttatgaccatttgac

SEQ ID NO: 616 - DNA, 25 bp, Diabrotica virgifera
gcaagagttgttcatccactgcatg

SEQ ID NO: 617 - DNA, 28 bp, Diabrotica virgifera
gtgcggcaaaataagactccatttaggt

SEQ ID NO: 618 - DNA, 846 bp, Diabrotica virgifera
caagagttgttcatccactgcatggacttttgggtaaaagacgtatagcaggttttacaaagcttcggtaattggacacatatttgacattgatcagtcaactgttatacaacatactcatttttatttcaaggaaataatcttagaataagtattttttgcgtaaacatgttatatgacgtataatagataatatgatgtatattccatagacatgtatattattatcatagactgagcctaccctccgcgcttcctggcgacaagatctcttggacaggtttgcggtatctctttctagcacattgtatcgagaaactaacatgaaactgagtgggggtataggcacggaaagggaggactactgtcgcagctttactatgcataagagtgaaacagcactgagccacaaaaaaaaagatggtgtcgtcacttcgcgcaacatgacactctatgataatgtatgtgtctatggtatatcccagtggacatcctgagtcttgacgtcacaaagttgggagtagcttatatttggctccaaacaattctgtttgtagtgttaaacactcatagggaatttttaatttattgtttatgtggtttgtgtgacaaggtaagacttttcatttgggtatttagttggagagacgtgccagttgggagatttttattcgtttttgcccaggtgagttaatttaattaaatgattagaatgtaaacagttttgaggttatgtttattttccatcactaaggaataaaaaccacctgagcaggaacgaataaaaaatctcttagttgacacgtttctttgacggaatacctaaatggagtcttattttgccgc

SEQ ID NO: 619 - DNA, 967 bp, Diabrotica virgifera
acaattattaaaaataatagttagtaataaaataatgacaaaaatttctttaggctattgcagggtgggctttaaactttgagttggtcactttatgacttttataataataatttttaatcgagttattaagccttgaaaatggccattttcgcgtttttcaaatttgaaattgcatgtaactcggcaacagtcaattttatagaaaaatcacaagataccttttttgctcagcttgatccagaaaatctaaaacaagtttgtccgaagtgaaaaaattgattttttgaattcgtttaaaaaaatgtgtagaacaactttccgaccgcggtactgcctggcaccttgtgaatttgttataaggacctgtttttgagtaagtttgtgcaaaaaaattaatcggaataatttacctaacgggacaagcatacagcgtggactatttgcattatgagccaaacgtaaatggtttgtaaaatacactaaacacaaaaaaaattagcagccatcgccaaaaaaagttatacgtacctattaaaaaacaaaaaaaatgaggttataatatgtacactcgaccttcgggtccgtaaaaatggatgttctgtaaaagcctcagctgtgcgtgtgaattttttgtaatttataatttaataattactaactgttctaaatacgaaatgagccacagtttggctaaaaaatgattttttctacaaccgtgttaaaaatgcaatttttagcactccatacgtgcgttaaaaatgctactttaagacactagtgctttaaaatatttttaaggcactgcagttcgtattgaccgtatagacaattttgatgtaatgtcaaaaaaatataaaaatggaatgtcagtcacgttcaaagtaaaagttttgtagatattgtcctgtaatttacgttgtaaacaaatattgtatgagatgttaaaggtacatttttaggcact

SEQ ID NO: 620 - DNA, 31 bp, Diabrotica virgifera
gctcagcttgatccagaaaatctaaaacaag

SEQ ID NO: 621 - DNA, 32 bp, Diabrotica virgifera
ctgtggctcatttcgtatttagaacagttagt

SEQ ID NO: 622 - DNA, 458 bp, Diabrotica virgifera
gctcagcttgatccagaaaatctaaaacaagtttgtccgaagtgaaaaaattgattttttgaattcgtttaagaaaatggttaaaacaactttccgaccgcggtactgaatggcaccttgtgaatttgttataaggacctgtttttgagtaagtttgtgcaaaaaaattaatcggacaagcggattaacgggacaagcatacagcgtggactatttgcattatgagccaaacgtagatggtttgtaaaatacactaaacacaaaaaaattagcagccatcgccaaaaaagttatacgtacctattaaaaaacaaaaaaaaatgaggttataatatgtacactcgaccctcgggtccacaaaaatagatgttctgtaaaagcctcagctgtgcgtgtgaattttttgtaatttataatttaataattactaactgttctaaatacgaaatgagccacag

SEQ ID NO: 623 - DNA, 1376 bp, Diabrotica virgifera
cggacgcgtgggttcaagcaactgttagccttgatcctggggataacagtcatggcgttcgtcaccaacgctttcgagtgatggcgaccacaaaacattatcacaaatgtacttgaagcaatagtttatttgaaataatcagaaatttccataattagtggttagtattattagttgcggttttattaataagtgtcaactgtcatttgtcaaaatgtcaactgtcatttgtcaaaatgtcatctgttatttgtcaaaatgacagatgacaataactcaactgtcagttgtcaaaaagatggcgtaaaaatatataaattagttctgtagagtataaaagtcctttatgtaattcttactttcaaataaactcttgcactgacaaattaaatgtaattttgacagtttctgaaaggtttgactaaatgtaaatgtcagaattatatatctgttgatttttatacaggcacatcaaacatattaacatacacaattgaagatcgttgtaactgatatctgcagtcaacaatttggaaattgcttcacagctaactcaaattagaagttatgtttcacaactgcataaaataattgttaacaggatcaatattttattgtttatattagtttttgtaaagatatgtttcactagtacttaaatatcgatcagagacacaaactgtgttagaaaaggtccatggaatgtatcaatatgattttattttttatatcaccttcatttgtgcattccggtctcaataattaatgtaaaacgtcaaattttcgtttcaggcgacaattactgatactgcctacaaatagtggtataaggcttttcatcgattgtcatttgtttcgagcttcttctgtcatctagcaggcaagaccgcctaaatgcggtataatttctagctatttcagctatgtttaggtatgcagcatgcaaacctgcctttggtcgtatactactaagtgtacttgtaaatatttggttaacgctaattgattggctctattaagtcaaaagatatcaagctttgaatttttccattgaaaataaaattggcctgctagagggataatctgtgtataatattaatatacacggattataccacatattatgacagaagctcgaaataaatgactgaatgaaaagccctatggagcgagacttgtcagaacatgttttggtttcacctaaccttacataacctacaatttatctgaatagctgtctattgagatatattttgtctgccactgtcttttttatgaataacaattactgttttacctaaaaacaattaaaaaacatgtgataatgcgcgcgtacgcatttaatattttattaatatgcatacttcctcgtgccg

SEQ ID NO: 624 - DNA, 26 bp, Diabrotica virgifera
ggataacagtcatggcgttcgtcacc

SEQ ID NO: 625 - DNA, 28 bp, Diabrotica virgifera
catgttctgacaagtctcgctccatagg

SEQ ID NO: 626 - DNA, 1148 bp, Diabrotica virgifera
ggataacagtcatggcgttcgtcaccaacgctttcgagtgatggcgaccacaaaacattatcacaaatgtacttgaagcaatagtttatttgaaataatcagaaatttccataattagtggttagtattattagttgcggttttattaataagtgtcaactgtcatttgtcaaaatgtcaactgtcatttgtcaaaatgtcatctgttatttgtcaaaatgacagatgacaataactcaactgtcagttgtcaaaaagatggcgtaaagatatataaattagttctgtagagtataaaagtcctttatgtaattcttactttcaaataaactcttgcactgacaaattaaatgtaattttgacagtttctgaaaggtttgactaaatgtaaatgtcagaattatatatctgttgatttttatacaggcacatcaaacatattaacatacacaattgaagatcgttgtaactgatatctgcagtcaacaatttggaaattgcttcacagctaactcaaattagaagttatgtttcacaactgcataaaataattgttaacaggatcaatattttattgtttatattagtttttgtaaagatatgtttcactagtacttaaatatcgatcagagacacaaactgtgttagaaaaggtccatggaatgtatcaatatgattttattttttatatcaccttcatttgtgcattccggtctcaataattaatgtaaaacgtaaaattttcgtttcaggcgacaattactgatactgcctacaaatagtggtataaggcttttcatcgattgtcatttgtttcgagcttcttctgtcatctagcaggcaagaccgcctaaatgcggtataatttctagctatttcagctatgtttaggtatgcagcatgcaaacctgcttttggtcgtatactactaagtgtacttgtaaatatttggttaacgctaattgattggctctattaagtcaaaagatatcaagctttgaatttttccattgaaaataaaattggcctgctagagggataatctgtgtataatattaatatacacggattataccacatattatgacagaagctcgaaataaatgactgaatgaaaagccctatggagcgagacttgtcagaacatg

SEQ ID NO: 627 - DNA, 1142 bp, Diabrotica virgifera
tttattgtattaatgtataatgtgcagtatcattcagacctagtatttaaagaatttattttaagtttttattcatacacacatttttttatgattatactagttaatgctgttaagtcatagataagataggtagatgttaagtcatgtttgttctcattttttgtaacttcggcttgtaatatttgtggaagttaaaaagtagattgtttcattttctattagtacaaaaatgttgaacaacaattcaatattttacaaaagtcaagtggttttaatgtatctttggtttatttaacaaaaaaatttaattggatagaaattgcatatattctgaaaaccatgctataactgccagatttgtgaacaaacaatagcaagttcctaagaagaacttccgtagcagctatacaaatttaaacctctgtttaaaaaatctgaattaagagtatatgatataggcacataaaagtgatgtcgaaattaggagtacaaaatgttaatttttaataattaatttggcatatgagactaactgaaggcaaacaaaacttaataacatcataaaatcattgcaataaaaaactgaaaactttttgtcttccatgtttttatgtggcgcagaaggtacaaaaacgtaaatctgtaatttaaaacaattactgtttttttatacgtagttctggcaaagttttacatttgcattttagaaaaatgtgtttcatgttgtgtagtaaagccaaatttagttaactgtaaaaataaattacaaatttattttggttgtgaattggcccgaaaattttttttatatctacatttattcagttttgccaaactactaacagatacgtattttcgaatatccttttgattttaacaaagagcattgattattttaagcttctagatgtgaaataaacggtcaaccacaaaaaaaaaaaaaaagggcggccgccctttttttttttttttaacataatagtgaaatctttattttaatacatattatagtgacacattataaagccaatacattaacggcttataacgcatttgtcgttactcgatccatctacttgtgacagttggaagctgacgaagatattcgcagcttgtccttcaagtgggtcaatatcatt

SEQ ID NO: 628 - DNA, 28 bp, Diabrotica virgifera
ccatgctataactgccagatttgtgaac

SEQ ID NO: 629 - DNA, 31 bp, Diabrotica virgifera
gtggttgaccgtttatttcacatctagaagc

SEQ ID NO: 630 - DNA, 593 bp, Diabrotica virgifera
ccatgctataactgccagatttgtgaacaaacaatagcaagttcctaagaagaacttccgtagcagctatacaaatttaaacctctgtttaaaaaatctgaattaagagtatatgatataggcacataaaagtgatgtcgaaattaggagtacaaaatgttaatttttaataattaatttggcatatgagactaactgaaggcaaacaaaacttaataacatcataaaatcattgcaataaaaaactgaaaactttttgtcttccatgtttttatgtggcgcagaaggtacaaaaacgtaaatctgtaatttaaaacaattactgtttttttatacgtagttctggcaaagttttacatttgcattttagaaaaatgtgtttcatgttgtgtagtaaagccaaatttagttaactgtaaaaataaattacaaatttattttggttgtgaattggcccgaaaattttttttatatctacatttattcagttttgccaaactactaacagatacgtattttcgaatatccttttgattttaacaaagagcattgattattttaagcttctagatgtgaaataaacggtcaaccac

SEQ ID NO: 631 - DNA, 1137 bp, Diabrotica virgifera
  modified_base (1128): n = a, c, g or t/u
agtaaatttaaaacagatattgtcgaaaaaattatgagcaaagattaaggcacgagaatttcaaaaaattatttcccattattactattgataaaattgactagcttattatttactattgaactggttatatgcattatgtgataataggctggcattaataatatctgtccattagaaaaactgttaagtgctcctgttagcgatccgatttttagctaggtttaaagtataggtaactctgtcgcctgattcctcctcggcacatcggtcctacatccgacaatattttacggagtgtttcataacataacacggatatattgattaacaaatattataaatagtttctgtgttaaataagagttgtacaacatctacagttttgcatcgagctgacctagtttaaaaaaggatcgttaacaagagatgtaaagacgcagatatactcgactatcgtccagatatttgtatatacagcgtcttaagatgtatcatttaacgaaatatacagtttttacaagaagaaaagataatatagtatggtaaccttatcatcaaattaacatcgcataaaaaccgttcaagaaacacagagatattgaggaaaagaaaagcacaacattaatttaatcaaaaatatttctgttttacaatatatctcactaagaaacatttctgatttataatattttagatatgtttagagggagttatagaccagggcgcatctgtaaaaatattagtacatttggacgttgagaggtgactcaaatttctttgcagaaattgcacgaaaacaactcaaacaacaataattgagtcaatcatcccactcaaaaaggtccgggaacattgcctaattaatcaaaatgtcaaaaactgaaggaaaatttcgattttttccttggtcttttgattataactttaaaactattcatttctgagaaaagttgtaccgacatagaagttgcgtaactaaatttcacacattatagaattggtcaaaaattcaaaaaatagtcacccctgttgcaaaacagcaataattgcgaaaaaaccatacaaaaacaagtattcgcattttacgcttttcaaccatttatgctacacttaggacccttttcnggacgcgtg

SEQ ID NO: 632 - DNA, 28 bp, Diabrotica virgifera
gtgctcctgttagcgatccgatttttag

SEQ ID NO: 633 - DNA, 31 bp, Diabrotica virgifera
gcaacttctatgtcggtacaacttttctcag

SEQ ID NO: 634 - DNA, 781 bp, Diabrotica virgifera
  modified_base (100)  (880): n = a, c, g or t/u
gtgctctgttagcgatccgatttttagctaggtttaaagtataggtaactctgtcgcctgattcctcctcggcacatcggtcctacatccgacaatattntacggagtgtttcataacataacacggatatattgattaacaaatattataaatagtttctgtgttaaataagagttgtacacaacatctacagttttgcatcgagctgacctagtttaaaaaaggatcgttaacaagagatgtaaagacgcagatatactagactatcgtccagatatttgtatatacagcgtcttaagatgtatcatttaacgaaatatacagtttttacaagaagaaaagataatatagtatggtaaccttatcatcaaattaacatcgcataaaaaccgttcaagaaacacagagatattgaggaaaagaaaagcacaacattaatttaatcaaaaatatttctgttttacaatatatctcactaagaaacatttctgatttataatattttagatatgtttagagggagttatagaccagggcgcatctgtaaaaatattagtacatttggacgttgagaggttactcaaatttccttgcagaaattgcccgaaaacaactcaaacaacaatatttgagttatcctccctttcaaaaaggtccggaacattgttcaaacaatcaaaatgtcaaaaataaaggaaaaactcgattttttcttcgtctcttgactacaacttcaaaagtattcatttctgagaaaagttgtaccgacatagaagttgc

SEQ ID NO: 635 - DNA, 1142 bp, Diabrotica virgifera; identical to SEQ ID NO: 627

SEQ ID NO: 636 - DNA, 27 bp, Diabrotica virgifera
ggaacgtacacaaaagtttgggagggt

SEQ ID NO: 637 - DNA, 25 bp, Diabrotica virgifera
gaacagcaaccagcctgatacgacg

SEQ ID NO: 638 - DNA, 582 bp, Diabrotica virgifera
ggaacgtacacaaaagtttgggagggtttaagggaacaaaacccccttaaaatttttatggggtggacaaatttcactataattttgtttaaagatggttctgccatgagaatgatacatgtccattttcaataaaaagtatctaatagttttcgatatattgaaaaagatcgattttcattttgtaacttcaaggggctgtaacttttatgatgagcacatttgtaccaaggtaagttagattcaatcaaactatttttgaccccagaatgtgtggtataatttgtgaccaatcttttcgggacaccctgtatacaatatatgttccctatgtccagctgaacgatttacgtaggttagatcgactaatatagtaaacgacaattataatacgttttgtcgacaattataatacgttttgtcgtcatattttaaaagactcacattttaatgactgacgttaaatatacacacttctccatcaattcgataccatgatgttgaaatacgatatcaaaatgtaaaagaggcacaaactgaatgcagacgttcagtgacgtcgtatcaggctggttgctgttc

SEQ ID NO: 639 - DNA, 1039 bp, Diabrotica virgifera
  modified_base (748)  (896): n = a, c, g or t/u
ccttcgcgtccgtgataacaaaatcaatcaaagagttgtttactaaataattttgataatatatttgaataataataattgatgtaaggcgtacaattaataaaaagttatttattgtttatatattatttatggaaaatccaagtatttcaagtcattaaagttcaaataaaagtattattttataagagtttgttccgataaccgtaaataggtacgagtttagctataaagtaaagtgaccgtggtggcataaaatgtagtaaatgctaatgcttcaagcacgtactacatttttgaagatttcactacacttaaaaagcatatttgcttttctccgtagtatttgctactatttaccagcctacatagaagaatgtactacgctttttaaatatgtgcttgtttagtactatttggcttcagtttaagtgaagttggtgggtggacgttttcggcgtaggtatttttttgttacaatatggcagcatttatgaatgtatgtcatagaaaaatttacaaactacgaagaagattcttaatttttggggtcattcttttatcaaataaaatttaataattgtgaagaagattaacaaataacaattgtttatttttatccttgcgtaactctttggtcgcttcggatctgagtcactcatttttactcatgtacaattctaataatttggtacgtaaaatgtgaattcacaaatcaaaagcacatggaaaactaattccatcacgnatggtgtaatgcagacaccgctggcgctacgctttgtagtagatacttctggtcagtagtaggtactttctgtgtgtactaagntctcaacaaaagcacctactttttatgtaaaagaaaatgctacaaagtaatgactatttactgnagcaataacatctactacgtttatgcattccgcccatttcttgagtgaattattaaatgtgacttctattttataaaaaaaattttagggttttaaattaaaggttcccttttaccgaaagttttaacaaatttttttttttc

SEQ ID NO: 640 - DNA, 29 bp, Diabrotica virgifera
cgtccgtgataacaaaatcaatcaaagag

SEQ ID NO: 641 - DNA, 34 bp, Diabrotica virgifera
ctactgaccagaagtatctactacaaagcgtagc

SEQ ID NO: 642 - DNA, 798 bp, Diabrotica virgifera
cgtccgtgataacaaaatcaatcaaagagttgtttattaaatagtattgatagtgtatttgaaaaataataatttatttaaggcgtacaattaataaaaagttatttattgtttatatattatttatggaaaatccaagtatttcaagtcattaaaattcaaataaaagtattattttataagagtttgttccgataaccgtaaataggtatgagtttagttataaagtaaagtgcccatggtgtcataaaatgtagtaaatgctaatgcttcaagtacgtactacatttttgaagatttcactgcacttaaaaagcatttgcctttctccgcagtatttgctactatttaccagcctacatagaagaatgtactacgcttttgaagtatatgcttgtttagtagtattttgcttcagtttaagtgaagttggtgggtggtcgtcttcggcgtaggtatttttttgttacaatatggcagcatttatgaatgtgtgtcatagaaaaatttacaaactaagaagaagattcttaatttttggggtcattcttttatcaaataaaatttaataattgttaagaagattaacaaataacaataattgttcatttttatcctcgcgtaactctttgtcgcttcggatctgagtcactcatttttactcatgtacaattctaataatttggtacgtaaaaatgtgaatttacaaatcacaagcacatggaaaactaattccatcacgattggtgtaatgcagacacggctggcactacgctttgtagtagatacttctggtca

SEQ ID NO: 643 - DNA, 1035 bp, Diabrotica virgifera
  modified_base (790)  (857): n = a, c, g or t/u
ctaataactgacaaaataacgcaaaagatggaaaacatataagttgtgagataaggggaaaagagactggtagagatgctaaatttagtgataaaagcctatgaacttgcattctacttggtgtttcccacctttagacatatcagagctatatgtcaactaaaactgtcactgtcacagtgtcagttaacaaacaagtccaatatgtctaaaggtgggaaacagcagatagaatgtggatttataggttttatcactggatttcgcacctctactagtttaattcctttttatctcacaacttaatatgttattagcatgctcatcactgtatactgactaactttttttgttttttaacctcaccaaaccttttttattcgtatctgtatatttatcgaagttcaaatgtattttttttattcttccaaatgagccagaaacttgacaaaaaaacaattttctgaatcccttcgaataaaattctttttaagtttatctcatcggaataaaaaataccttttctctcttggtaatttttcgaaaaatgcttccttttcacgttgtttgctattttttgttaaagaaatgccttaattagcgatttttgggattttttcccaaaaactactcaatgaattataattctacaaaaggctttataatccttaaaccctcaagtataagtaagaatattttgacaaggacacatggtttatatctcgctgaaaacatggagtcaaaaattcatctaaaataggcccttcagacagtctaccgctgccatgtngcctaagtgntggacagtgggttgcagaaaaacgggcacatgtcacataaatatttgtataaatttnaaactatcgtttgagcaagatagaagccacttatccttgtcaaatattaataataaggttttaagatataaagtttttatatactacatttcatttagttgtttcttagaaaaaaatcgcaataactcaaaattcgtccctgaaaatttttactaaatgattccgaaaaatgtttttt

SEQ ID NO: 644 - DNA, 31 bp, Diabrotica virgifera
gttgtgagataaggggaaaagagactggtag

SEQ ID NO: 645 - DNA, 30 bp, Diabrotica virgifera
gacaaggataagtggcttctatcttgctca

SEQ ID NO: 646 - DNA, 853 bp, Diabrotica virgifera
gttgtgagataaggggaaaagagactggtagggatgctaaatttagtgataaaaacctataaacttgcattctacttaatgtttcccacctttagacatatcagagctatatgtcaactaaaactgtcactgtcacagtgtcagttaacaaacaagtccaatatgtctaaaggtgggaaacaacagatagaatgtgaatttataggttttatcactaaatttcgcacctctactagtttaattcctttttatctcacaacttaatatgttattagcatgctcatcactgtatactgactaattttttttgttttttagcctcaccaaactttttttattcgtatctgtatatttatcgaagttcaaatgtattttttttattcttccaagtgagccagaaacttgacaaaaaaacaattttctgaatcccttcgaataaaattctttttaagtttatctcatcggaataaataataccttttctctcttggtaatttttcgaaaaatgcttccttttcacgttgtttgctattttttgttaaagaaatgccttaattagcgatttttgggattttttcccaaaaactactcaatgaattgtaattctacaaaaagctttataatccttaaaccctcaagtataagtaagaatattttgacagggacacatggtttatatctcgctgaaaacatggagtcaaaaattcatctaaaataggcccttcagacagtctaccgctgccatgtgcctaagtgtggacagtggttgcagaaaaacgggcacatgtcacataaatatttgtataaatttaaaactatcgtttgagcaagatagaagccacttatccttgtc

SEQ ID NO: 647 - DNA, 1017 bp, Diabrotica virgifera
cgaactatttttggtcccagaatgtgtgatttagtttgtgacctgtatttttgttacaccctgtatatgagatacaaatgaatcgcgatgattttttctaactagcgatttcggtatatgaatctgaatcctgacagatgtaaacatagactaaataaactacactcagagaaaaaaatgatgtgaaataaaattattcggaggtagataagtgaaaaaatacgaacgaacagtaggaaattaaaggccttggggaaatgtggataaggtctgaaatgacaggctgcgttctgttgataggtttgctcttatttaaaaaatgtgaaaaattcattattacatcagcaatttatccctttcttgagtttatggaacttatcagtttttctaaattaagcgtttcaaatcaaattttttaggaagtgtttttaaagggacgattattctttagtttttaaaatgcgttttatccaatgttgcctacttcttaaatgtatataacaataaaagcaataccattttggatgttacataggttgttaataaacagatgaaaaggtgtgtttgtctaagaacaggtatatatttgcaatgatatagagattactgtagttaaagaaactatgcaaaagattagaggtgatagtggatacagttgatagctaataaatcaataattctatacatttatcttcgattaaataattatgttattgtggttttcatggaaactattaaactattttaattaatgacgaaggtagaataccttaaaacttctccatggctctgtcagaagatatgaagtgttcatttattaataagtttcctagttggaagggatttctaactttgtaattataaaaaattttttaaaaaatttcttcttatttatctggagggttttttgaatccaccgctggtaccattattttttaacaaataaatggtaaaaacaaaaattttatgggaaaattttcttacggggggggctttcacaccaggaaatttgttttt

SEQ ID NO: 648 - DNA, 28 bp, Diabrotica virgifera
ggtcccagaatgtgtgatttagtttgtg

SEQ ID NO: 649 - DNA, 30 bp, Diabrotica virgifera
gaacacttcatatcttctgacagagccatg

SEQ ID NO: 650 - DNA, 806 bp, Diabrotica virgifera
gtcccagaatgtgtgatttagtttgtgacctgtatttttgttacaccctgtatatgagatacaaatgaatcgcgatgattttttctaactagcgatttcggtatatgaatctgaatcctgacatatgtaaacatagactaaataaactacactcagagaaaaaaatgatgtgaaataaaattattcggaggtagataagtgaaaaaatacgaacgaacagtaggaaattaaaggccttggggaaatgtggataaggtctgaaatgacaggctgcgctctgttgataggtttgctcttatttaaaaaatgtgaaaaattcattattacatcagcaatttatctctgggccctttcttgagtttatggaacttatcagtttttctaaattaagcgtttcaaatcaaattttttaggaagtgtttttaaagggacgattattctttagtttttaaaatgcgttttatccaatgttgcctacttcttaaatgtatataacaataaaagcaataccattttggatgttacataggttgttaataaacagatgaaaaggcgtgtttgtctaagaacaggtatatatttgcaatgatatagagattactgtagttaaagaaactatgcaaaagattagaggtgatagtggatacagttgatagctaataaatcaataattctatacatttatcttcgattaaataattatgttattgtggtttcaatggaaactattaaactattttaattaatgacgaaggtagaataccttaaaacttctccatggctctgtcagaagatatgaagtgttc

SEQ ID NO: 651 - DNA, 1013 bp, Diabrotica virgifera
  modified_base (657): n = a, c, g or t/u
cgaccgcacaaaaaaattgttaaaaggaaattgtaatatattgtaaatgcgatttatttggaacaatttcagttcctaacatttttgtcacaaagttaaaaatggcggagatattgaacaaaaacaactgctagacgaccaaaaaaatgaaatagataaaaattatataaaatttaattgtctccatttttgtataggtacatttttgtcgtaaaactaataataaacgcgataactcaataattctgctgttacttttttcccccattactcggaaaatatcgaccgcacaaaaaatttgtaataaaagacattatagaaaatcatattttcaacaatttcagtcgtcgcactttttgtcgaaaagttgaaaatgacggagatattgagcaaaaacggctctcctttaaattcaacatggcggctaacgtaacggcggaattcactcgcgatattaaatttacactactattgacacccgtaaagattagaaaaattaaattttggacatctcggcatgcaaggtcaaagctaaagtcctgtattttggctatctgtaggaaaacatcaaaataacttattataatgctgtttaatgacatttttgagccccttatgttgaaacattattttttttaattgatactttctgataanatatacaaatttattaaaataaacaccaaatcactgtgaaattgctacaaatgatatttaaaacattttttatgttgcgcagaagctatgcaccaagttttttggatccaaattgagtggtttgaaatgaatcgcccataaatatttgagtttattgtcattggaaactataagcaagtattacaatacgcttaatttttaattttaaatagggatttggactgactatgaatctgatcaatattttttaaataattgtaaaatttgatgagtcattatccctgtgtgggtctgattgtttttaatagaaactttttttaaacagtgtaatatttctagtaaaataattttcaacc

SEQ ID NO: 652 - DNA, 31 bp, Diabrotica virgifera
gatattgaacaaaaacaactgctagacgacc

SEQ ID NO: 653 - DNA, 29 bp, Diabrotica virgifera
gatcagattcatagtcagtccaaatccct

SEQ ID NO: 654 - DNA, 789 bp, Diabrotica virgifera
gatattgaacaaaaacaactgctagacgaccaaaaaaatgaaatagataaaaattatataaaatttaattgtctccatttttgtataggtacatttttgtcgtaaaactaataataaacgcgataactcaataattctgctgttacttttttcccccattactcggaaaatatcgaccgcacaaaaaatttgtaataaaagacattatagaaaatcatattttcaacaatttcagtcgtcgcactttttgtcgaaaagttgaaaatgacggagatattgagcaaaaacggctctcctttaaattcaacatggcggctaacgtaacggcggaattcactcgcgatattaaatttacactactattgacacccgtaaagattagaaaaattaaattttggacatctcggcatgcaaggtcaaagctaaagtcctgtattttggctatctgtaggaaaacatcaaaataacttattataatgctgtttaatgacatttttgagccccttatgttgaaacattattttttttaattgatactttctgataaaatatacaaatttattaaaataaacaccaaatcactgtgaaattgctacaaatgatatttaaaacattttttatgttgcgcagaagctatgcaccaagttttttggatccaaaattgagtggtttgaaatgaaatcgcccataaatatttgagtttattgtcattggaaactataagcaagtattacaatacgcttaatttttaattttaaatagggatttggactgactatgaatctgatc

SEQ ID NO: 655 - DNA, 1012 bp, Diabrotica virgifera
  modified_base (929)  (949): n = a, c, g or t/u
catatttctttaataataatcaattgctgaacagataatgcacacaaatataatgtacactttcaacagtgcaatgtaacacacaagtcgcctgctgaatcgcaaaataaattatgttatctaatgtattgtttgaaagaccactaagtaccgattcggcattccagattgtaaggaaaaatgcaataagtgcaataatgagttttaccatgaaaccgaaattcacaatcttggaaggaaaaattcactaagtgcaataatacgttttaatgagttttgccctgaaaccaaaattcacaataatgcacttagtgaattgtaccataaattatctcagcaattagaagggttagagtcccaggtgacttctccagagctgggcagtaccgtatcgagttcaaattaataaaaatgtcaatatctcaaaaaagtgcacttagttagttttacctctaataggacgatttgtcttgttttatccattatgatacattcacttcattatgtacaagcttatcgatatttgggtaagtgtcgactaggcagagtcagttcaattactatttcttccttgagtgttatgcttccatcatcagccaagttaatgttgtataagtatcatactccatatcatagacaaatattcttcagtcacaaaatatggctcagtaatagaagaagagaagatagaaggactggatggcagagaacttgagaaagtgaaatacacactacaaaaactttcaatgccagtcttttgagatacatatttggtcattaggtgatattcagattttgcgatattacatattgtaggactggtatgggaggagattctacaggcaaaagaccactcggacgtcccagaatgtgatggagagatacatccaagcagatctccgaaaaatgaacatcccatttgaccctangntgatggaagaccaacaanttggaagaaagtgtacagtcagccaggacccaccccagggtgtagcgctacgtgatgatgatg

SEQ ID NO: 656 - DNA, 28 bp, Diabrotica virgifera
tcaacagtgcaatgtaacacacaagtcg

SEQ ID NO: 657 - DNA, 27 bp, Diabrotica virgifera
tgtatctctccatcacattctgggacg

SEQ ID NO: 658 - DNA, 825 bp, Diabrotica virgifera
tcaacagtgcaatgtaacacacaagtcgccttctgaatcgcaaaataaattatgttatccaatgtattgtttgaaagaccactaagtaccgattcggcattccagattgtaaggaaaaatgcaataagtgcaataatgagttttaccatgaaaccgaaattcacaatcttggaaggaaaaattcactaagtgcaataatacgttttaatgagttttgccctgaaaccaaaattcacaataatgcacttagtgaattgtaccataaattatctcagcaattagaagggttagagtcccaggtgacttctccagagctgggcagtaccgtatcgagttcaaattaataaaaatgtcaatatctcaaaaaagtgcacttagttagttttacctctaataggacgatttgtcttgttttatccattatgatacattcacttcattatgtacaagcttatcgatatttgggtaagtgtcgactaggcagagtcagttcaattactatttcttccttgagtgttatgcttccatcatcagccaagttaatgttgtataagtatcatactccatatcatagacaaatattcttcagtcacaaaatatggctcagtaatagaagaagagaagatagaaggactggatggcagagaacttgagaaagtgaaatacacactacaaaaactttcaatgccagtcttttgagatacatatttggtcattaggtgatattcagattttgcgatattacatattgtaggactggtatgggaggagattcctacaggcaaaagaccactcggacgtcccagaatgtgatggagagataca

SEQ ID NO: 659 - DNA, 990 bp, Diabrotica virgifera
atgatacaatttactattcatgcttcattcattcatgctattctttagagcattccacagtgatctgttaaaatctagacgtcacacgaagaactggaattttccaagagtatcgaacaacaaaatatccaaatgtaacctcaaaatagtatcattcgcttatacaaaacaatgctataatatgatccttgctacataaactcactaatcacagttaaggggggaggggtatggtttgacatcagcatttcgagcacatttttgtgaattttttgaatctatattagaattatttttaaattaaataaatagattcagtagagataggcgttacctcacgaaatatctaaagaaagtctgcaaaatttcaggtggatcggtaaaatagttttggagttacaatatccaccacctttgaaaaaagcagttttgagaaaaatgcgttcaaagttttgaaaactttattttcaattttatttttgtttgtcaaatcgtaaagtaatgcacaccgaaatatgtttttgcatcgcggagtaatttacaaaaggggaacagctgttgaacgtttctaactacgctcaagcacgctgtagcgaagctgccgcaaagcgagtcgaaggtagggatatttacttgctgtatctctggtaattttactccaatcaatctgaaattttcggagagtagtcttgaagttaattttaaaatttcaaaccgtttcaacctccccccttaatcacaaaaccttcaactgtgttattcacttcacttcaaatcgagttatacctataacactctactggaaagattcatactctatgtgttgtcacgttctagtatttcataaatattattaaaagcgcttaaaatttcagctagatggacgaaatttacttttttagatccctagtttttcaaattttacgtgctatattttttctgcgtacgatatacctcctcgcacattataggtactggagggaaaggtta

SEQ ID NO: 660 - DNA, 32 bp, Diabrotica virgifera
agagcattccacagtgatctgttaaaatctag

SEQ ID NO: 661 - DNA, 31 bp, Diabrotica virgifera
cgatttgaagtgaagtgaataacacagttga

SEQ ID NO: 662 - DNA, 688 bp, Diabrotica virgifera
agagcattccacagtgatctgttaaaatctagatgtcacacgaagaactggaattttccaagagtatcgaacaacaaaatatccaaatgtaacctcaaaatagtatcattcgcttatacagaacaatgctataatatgatccttgctacataaactcactaattacagttaaggggggaagggtatggtttgaaatcaacatttcgagcccatttttgtgaattatttagagttagtgttacctcacgaaatatctaaagaaagtctgtgcaaaatttcaggtgratcggtaaaatagttttggagttacaatatcyaccacctttgaaaaaagcagttttgagaaaaatgckttcaaagttttgaaaactttattttcaattttatttttgtytgtyaaatcgtaaagtratgcacaccgaaatatgtttttgmatcgcggagtaatttacaaaaggggaacagctgttgaacgtttctaactacgctcaagcacgctgtagcgaagctgccgcaawgcgagtcgaaggtagggatattyacttrctktatctctggtaattttactccaatcaatctgaaattttcrgagagtagtcttraagttaattttaaaatttcaaaccgtttcaacctccccccttaatcacaaaascttcaactgtgttattcacttcacttcaaatcg

SEQ ID NO: 663 - DNA, 997 bp, Diabrotica virgifera
caaatctgtaatgtcaataccgcaactgtcaaataaatgttaccaatttatgccaatttatacctttgttcaatcgcagttagagtgtaatccgaacaagtgtgctttataaaaacgctttatattccacttatacagattaaacgaaacaagttagggtatatttctttatatttaaattaatagaaatctttcaatattatttctacgcgtatataataaaatatgtctagtggctgtaattccagtgtaccctgctaaacgattctaaaaaggaacacacctacgacttaaataatcgtgtgacgtcacgtgctataacgcggatgacgtgcaacggtgtctatattgtacggactgtattgaatgtgttaagtgtgtttaatatttaatattccgataactaatcgaataaaggattacagattacggtaaatatttattaaacatatatgattacaaacttttgtacatgttttattttagaccgtgacaagtgctctgatctgattgacgttgacaatgtgacaaatacactgacacctaaaggtgtgttcacactatacactaaacaaagtgttcaccaggtttcgcgtggtaaattgaaaacaaaacgtgactttctgttatgcaagccatatttttgttgaattcaacattttattggtcaccatttatgattagttaactagtaatttgttatgttgaatttggttatgcgatatccgataagaacttagcctctccgccctagtgcgtcactattgcaagggatatataccatcgtataatacattcttgtagaccgcctatgtcaaaatctgagccaaatcgggacttgtaatttttttaatttattaagaaaaacatacaatccccatccacccccgcagggttattaaaaggagtagtaacgtacccaaaaattccgttttaataataataaaaaagagggaatataaaaagtaaaatatttttaaaaaaatttaaacccctt

SEQ ID NO: 664 - DNA, 28 bp, Diabrotica virgifera
caatcgcagttagagtgtaatccgaaca

SEQ ID NO: 665 - DNA, 31 bp, Diabrotica virgifera
gtacgttactactccttttaataaccctgcg

SEQ ID NO: 666 - DNA, 848 bp, Diabrotica virgifera
caatcgcagttagagtgtaatccgaacaagtgtgctttataaaaacgctttatattccacttatacaaattaaacgaaacaagttagggtatatttctttatatttaaattaatagaaatctttcaatattatttctacgcgtatataataaaatatgtctagtggctgtaattccagtgtaccctgctaaacgattctaaaaaggaacacacctacgacttaaataatcgtgtgacgtcacgtgctataacgcggatgacgtgcaacggtgtctatattgtacggactgtattgaatgtgttaagtgtgtttaatatttaatattccgataactaatcgaataaaggattacagattacggtaaatatttattaaacatatatgattacaaacttttgtacatgttttattttagaccgtgacaagtgctctgatctgattgacgttgacaatgtgacaaatacactgacacctaaaggtgtgttcacactatacactaaacaaagtgttcaccaggtttcgcgtggtaaattgaaaacaaaacgtgactttctgttatgcaagccatatttttgttgaattcaacattttattggtcaacatttatgattagttaactagtaatttgttatgttgaatttggttatgcgatatccgataagaacttagcctctccgccctagtgcgtcactattgcaagggaaatataccatcgtataatacattcttgtagaccgcctatgtcaaaatctgagccaaatcggacttgtaatttttttaatttatttagaaaaacatacaatccacatcaaccacgcagggttattaaaaggagtagtaaccgtac

SEQ ID NO: 667 - DNA, 996 bp, Diabrotica virgifera
  modified_base (744): n = a, c, g or t/u
atttaatcagtcgtaaaaaaatatacagttcctctaattggcttagctcacgctgggttaagctgatttcaatagccattagactaatagtatttatgaatgactgtttaattgacttcaaacgatttccataaacttaattacaatttacgccgttattaatcaaaactcatagttggcgcaacgatttgaaattgttctaatttcgaggcgaatcatgtaaattttattgcgtttgagtgacattgtattttccataatatgcgtgcggtgtcctttacattgcaaactatttgtatttgagtagtatcgttaaatttcgagaggtaaaatattgaatagctggtataataattaaaagtacaatagattaacaatactttctacctgtaccggaaacttaccacaccattcaaatacaaatgactgtaagcttaaaatttttctggaatattttaatggcaactataagtagtttccgcggtgaaacaccttgtatgcatttaaatggtttcggctcacgtcagcaatgaaagatgctcattcttttcagtataaaatccaaaactaatttgagactgaatcgagttgggtgataaagttgtaatacggtgcgatatggagtctggcgtaagattttttgtacacgctgtatcgacacaaattgtgcagtatttaatgtaagatcatccattcttccgtatcttccaaaactttttaaatatactacgtttaaaactctanagttgattttagtttccccaaaacagcaatactcgcggtttagttgagttgaaagtgtgatagacaggttttagttactatataaatattttttttacgatttgtattagttgtaatatacaatgaaagacggaattgtttttcgttgtgtataaaactttgtgtgactttttgaaatgtacatagttctagtataagtttgttgtgctgagccacgagaagtatctcggttggaattgttccttttttttt

SEQ ID NO: 668 - DNA, 28 bp, Diabrotica virgifera
acagttcctctaattggcttagctcacg

SEQ ID NO: 669 - DNA, 25 bp, Diabrotica virgifera
cttctcgtggctcagcacaacaaac

SEQ ID NO: 670 - DNA, 949 bp, Diabrotica virgifera
acagttcctctaattggcttagctcacgctgggttaagctgatttcaatagccattagactaatagtatttatgaatgactgtttaattgacttcaaacgatttccataaactttaattacaatttacgccgttattaatcaaaactcatagttggcgcaacgatttgaaattgttctaatttcgaggcgaatcatgtaaattttgttgcatttgggtgacattatattttccataatatgcgtgcagtgtcctttacattgcaaactatttgtatttgagtagtatcgttaaatttcgagaggtaaaaatattgaatagctggtataataattaaaagtacaatagattaacaatactttctacctgtaccggaaacttaccacaccattcaaatacaaatgactgtaataagcttaaaatttttttctggaatattttaatggcaactataagtagtttccgcggtgaaacaccttgtatgcatttaaatggtttcggctcacgtcagcaatgaaagatgctcattcttttcagtataaaatccaaaactaatttgagactgaatcgagttgggtgataaagttgtaatacggtgcgatatggagtctggcgtaagattttttgtacacgctgtatcgacacaaattgtgcagtatttaatgtaagatcatccattcttccgtatcttccaaaactttttaaatatactacgtttaaaactctaaagttgattttagtttccccaaaacagcaatactcgcggtttagttgagttgaagttgtgatagacaggttttagttactatataaatattttttttacgatttgtattagttgtaatatacaatgaaagacggaattgttttccgttgtgtataaaacttgtgttgactttttgaaatgtacatagttctagtataagtttgttgtgctgagccacgagaag

SEQ ID NO: 671 - DNA, 991 bp, Diabrotica virgifera
  modified_base (906)  (921): n = a, c, g or t/u
attcgaacttcccagaagattgaatggataaatgcaggtactcaaatgtttgcaacatgttctatcgatgcttcttgaagacgtagctttattgtaataaaaaaattttatgtaagttgaaacactatacaaaccttatttattagatatttaataaacacaaacattatgctgtttttctattactgttatcagtattttatcaatgtatattatgcctatgatcgatgattcatgatagttgagttacagtaaaattattttagcacagaaggaacgcagcgctgccggctgtatttgcttttctgtggacattaatcaaatgcattaaaattaataaattatttttttgaaaacggttgacttaacaaaaaaaatttattagacttttttgctctaaatggtgcacttagcccataccttggaggaacgcactattttccgggacaccctgtatagtttaaaaattattttctgttgctcaatcggtcattcgttcgtggaagtagatacatcatgcattaattgaaagatctatccactggtggttgtaacttaacgtccgcatcattctgcgtttaattcaggttccaaaactgacatttaagtccaatattttttgttcacgtttggtacaaatattttttagaagggtatgcgtccaagttcttacgagctttgctgttgctgcctgctcctacgtcaaatgctgaatttgcatgaacactgaaccttactttccaaggaatatattaaataatatcatttatttaatacttttcgtagcaagctaagtaatgttaacgaagagaattatgactttgcttagcaaatacagagtttttattttatagccttgaatttttgttaattttgatatctatacgtatatattgttttatattngtacatgtactttgngtaatagctgccgatattgccattttttataaaaataacgagagcagaggtgtataaataaatttttggt

SEQ ID NO: 672 - DNA, 28 bp, Diabrotica virgifera
cttcccagaagattgaatggataaatgc

SEQ ID NO: 673 - DNA, 30 bp, Diabrotica virgifera
gaaagtaaggttcagtgttcatgcaaattc

SEQ ID NO: 674 - DNA, 733 bp, Diabrotica virgifera
cttcccagaagattgaatggataaatgcaggtactcaaatgtttgcaacatgttctatcgatgcttcttgaagacgtagctttattgtaataaaaaaattttatgtaagttgaaacactatacaaaccttatttattagatatttaataaacacaaacattatgctgtttttctattactgttatcagtattttatcaatgtatattatgcctatgatcgatgattcatgatagttgagttacagtaaaattattttagcacagaaggaacgcagcgctgccggctgtatttgcttttctgtggacattaatcaaatgcattaaaattaataaattatttttttgaaaacggttgacttaacaaaaaagtttattagacttttttgctctaaatggtgcacttagcccataccttggaggggcgcactgttttcagggacaccctgtatagtttaaaaattattttctgttgctcaatcggtcattcgttcgtggaagtagatacatcatgcattaattgaaagatctatccactggtggttgtaacttaacgtccgcatcattctgcgtttaattcaggttccaaaactgacatttaagtccaatattttttgttcacgtttggtacaaatattttttagaagggtatgcgtccaagttcttacgagctttgctgttgctgcctgctcctacgtcaaatgctgaatttgcatgaacactgaaccttactttc

SEQ ID NO: 675 - DNA, 990 bp, Diabrotica virgifera
  modified_base (825)  (935): n = a, c, g or t/u
aacgaatgccaaacctatgagggaacttacacatttttttattacgtaatattattcagtttcctttaaaaataatatttccaaactttcacgcggtaaaacctcataataacttagaagataatttaaaatctatatatttttttctgttttctggccttggtttagaagaacccttagccaatgtaaaatagttcaaactatcaaaaacgcttgtgacgttacattactgtattttctactgacgtttatagtgtctaatttaaaattatatacaattttgtttactttgttggtgcagaatgtacatgcacaactatatgacgtcaatatgcgttttggaccacctgttttaatttgaatttttaatcgtctttaggggccaaacgaaagacaaacaaaactttttttatctttgatacatgttttaaattatgttctgttgtgatttataacatttttttcgaatttaaaaatttatgcaagttccctatttacacaaacaatttaatatttccaacaagagcattatttaaaattccttgttcccgctaagggatagggacttcacatcctagcagggggcgttaagacgctagaaaaccggaagataagtatagctatcacagaagatatcggggaagaacaggtatgtacatcggttatgactataaatatctgaaaaatacatacatacttgtaaagtaaacaccactcttaccattttctaatattatctaagtattgactggacttttctatctgcctcatgaataatgaggtaaattagaatttcatttattttgcataaaaaatacatgtaanttccgttatcataaaataattataggaatatctaccgatattattactctggggtccgtatatctatcctttttttctacttttctactatggnnatgagaaataaattnaaattttaaaaacaatttggtggtattccctagaggaaatataaaattttatcta

SEQ ID NO: 676 - DNA, 32 bp, Diabrotica virgifera
agaagaacccttagccaatgtaaaatagttca

SEQ ID NO: 677 - DNA, 33 bp, Diabrotica virgifera
gatagatatacggaccccagagtaataatatcg

SEQ ID NO: 678 - DNA, 729 bp, Diabrotica virgifera
agaagaacccttagccaatgtaaaatagttcaaactatcaaaaacgcttgtgacgttacattactgtattttctactgacgtttatagtgtctaatttaaaattatatacaattttgtttactttgttggtgcagaatgtacatgcacaactatatgacgtcaatatgcgttttggaccacctgttttaatttgaatttttaatcgtctttaggggccaaacgaaagacaaacaaaactttttttatctttgatacatgttttaaattatgttctgttgtgatttataacatttttttcgaatttaaaaatttatgcaagttccctatttacacaaacaatttaatatttccaacaagagcattatttaaaattccttgttcccgctaagggatagggacttcacatcctagcagggggcgttaagacgctagaaaaccggaagataagtatagctatcacagaagatatcggggaagaacaggtatgtacatcggttatgactataaatatctgaaaaatacataatacatacttgtaaagtaaacaccactcttaccattttctaatattatctaagtattgactggacttttctatctgcctcatgaataatgaggtaaattagaatttcatttattttgcataaaaaatacatgtaattccgttatcataaaataattataggaatatctaccgatattattactctggggtccgtatatctatc

SEQ ID NO: 679 - DNA, 988 bp, Diabrotica virgifera
cggacgcgtgggtgttccggaccattttgagtgggaggatagctcaagtgttgttgtttgggttattttcgggcaatttctgcaggggggtttgagtcacctctcaacgtccatctcaaaacagatgcgccctggactaaaacaattttaagtactctcattgttaaaaagttgattcaccacattttcataacgatttttagggcggctgtacacggactgctgaggtcgtttatcactgagcgacatacacggactgctcgagcgatcgttgtagacttctggagcggtccattgttgactacctgagttgtcccttgtcgcattgcaaccgctctcgatctgtcgatagcacgatggaatttcattatgctattgacagcttgaagcggtcttgactgctcgagctgtcgtgtgtatggcaacgaatatacaattataattcaccgcgcaaacgctgcttcaaaaagtcgacctcaactgcttgaagatgtccgtgtacggccgatcttggggtatcttttttactcttatcgggaatatttaagaaccgaaatccctaatgttttccctatttgttccagaatgatatacgtgttaatttccaactgagacttgacggccagcacgaccgtacgacaagacattttcgaacagtaaaatcattagttttagtaacaaatacaaagacagatgggaattcggttctcgatattatgcagagtatttacctgatgatgaacacttattggaggatagaaacgcataatttgcagaactgacttacccatgtaatggacaggtatgatggaaacgtatgtactttaatgttttgttagtatttttacgagagaagctaagtaggtttgtgaagaattagttatttgttgtactcgatactttttattaactcattaattaattaaatcctacaaatacacaacgtaagaagctacatgagcgcgcagcaaaaatttttttttttttt

SEQ ID NO: 680 - DNA, 25 bp, Diabrotica virgifera
ggaccattttgagtgggaggatagc

SEQ ID NO: 681 - DNA, 33 bp, Diabrotica virgifera
ctaattcttcacaaacctacttagcttctctcg

SEQ ID NO: 682 - DNA, 862 bp, Diabrotica virgifera
ggaccattttgagtgggaggatagctcaagtgttgttgtttgagttattttcgggcaatttctgcagggaagtttgggtcacctctcaacgtccacctcaaaacagatgcgccctggactaaaacaattttaagtactctcattgttaaaaagttgattcaccacattttcataacgatttttagggcggctgtacacggactgctgaggtcgtttatcactgagcgacatacacggactgctcgagcgatcgttgtagacttctggagcggtccattgttgactacctgagttgtcccttgtcgcattgcaaccgctctcgatctgtcgatagcacgatggaatttcattatgctattgacagcttgaagcggtcttgactgctcgagctgtcgtgtgtatggcaacgaatatacaattataattcaccgcgcaaacgctgcttcaaaaagtcgacctcaactgcttgaagatgtccgtgtacggccgatcttggggtatcttttttactcttatcgggaatatttaagaaccgaaatccctaatgttttccctatttgttccagaatgatatacgtgttaatttccaactgagacttgacggccagcacgaccgtacgacaagacattttcgaacagtaaaatcattagttttagtaacaaatacaaagacagatgggaattcggttctcgatattatgcagagtatttacctgatgatgaacacttattggaggatagaaacgcataatttgcagaactgacttacccatgtaatggacaggtatgatggaaacgtatgtactttaatgttttgttagtatttttacgagagaagctaagtaagtttgtgaagaattag

SEQ ID NO: 683 - DNA, 978 bp, Diabrotica virgifera
  modified_base (876): n = a, c, g or t/u
aaaagaaatagaacgtaataatgaaacaacaacaaaaacaacctctggaacataagcatctactattaatttgatgcagctaaggaaataatatgggcaacaagtaaaaaagcctcctcaaacaaacagacagagtggtggtgacaaaaaaagaggtggcatagataggtgtcttttaggaaatatttggaaaagaacgaccatacttataataatacaactgtaaatgtgtaaaaaatcgtattgattttgctacttgtgtctattgtgtcattttattagatcacaatatatataaactgttgaactcgaccgtaagctgctttaaaaacaataaaatgttttgaaatgtagtaaatatgtcatcgaataagtgacgtcatagctaagtgtagacagtattgccaaaataatttgtatacataatggttcttctatttatacaaaactttaatctttttaatttcttctctttgtatttgactattaacaaagtgaaacgaattttgcaattattttagtatattaacgtagaaaaagatcaataattgactctagagacttttaattcttaacaaaattaaacaattatattaaacaccaaaactactctgatcaagtcatggtctctgcatattatttataccttagagctacactatttagaacaaaatgttaatataaacattttttaataggtattttgagatagaaagtgtatgtgaaaattctgtgtttataatgcaaaaccccatacacggcttaggaataagtttatgtaggctaaacacagacgaaattagttatatttatggaaactgagactacgacgtagttcgacgaaatataaacagtctacgggatgtcctatcgtgntatagccgaatcaaatttaatataagggtagttatgactaaaaaattgaaaaccgtacatgatcatatcacagtttatggcatacattatggtcaacacatg

SEQ ID NO: 684 - DNA, 27 bp, Diabrotica virgifera
agcctcctcaaacaaacagacagagtg

SEQ ID NO: 685 - DNA, 34 bp, Diabrotica virgifera
gaccataatgtatgccataaactgtgatatgatc

SEQ ID NO: 686 - DNA, 857 bp, Diabrotica virgifera
agcctcctcaaacaaacagacagagtggttgtgacaaaaaaagaggtggcatagataggtgtcttttacgaaatttggaaaaggacgaccatacttataatacagctgtaaatgtgtaaaaaatcgtattcattttgctatttgtgtcaaatgtgtcattttattggatcacaatatatataaactgttgaactcaaccgtaagctgctttaaaaacaatcaaatgttttgaaatgtagtaaatatgtcatcgaataagtgacgtcatagctaagcgtatacagtgttgccaaataatttgtatacataatggttcttctatttatactaaactttaatctttttaatttcttctcttttcgtatttgagtattaaccaagtgaaacgaattttgcaattattttagtgtattaacgtagaaaaagaccaataattgactctagagactttcaattcttaacaaaattagacaattatattaaacaccaaaactaatctgatcaagtcatgatctcgctgcatattatttataccttagagctatactatttagaacaaaatgttaatataaacatttttaataggtattttgagatagaaagtgtatgtgaaattctgtgtttataatgcaaaacccattatacggcttaggaataaggtaaggtaggctaaacacagacgaaattagttatatttatgggaactgagactacgacgtagttcgacgaaatataaacagtctacgggatgtcatatcgtggtatagccgaatcaaaatttaatataagggtagttatgactaaaaaattgaaaacgttacatgatcatatcacagtttatggcatacattatggtc

SEQ ID NO: 687 - DNA, 977 bp, Diabrotica virgifera
  modified_base (730)  (938): n = a, c, g or t/u
tatgaataaaaatagcatttttatatacaataacctggagacgggtcacaggcttcatgtgcaacacttaacaccttcagctccaggccaatatctgatatttgccacatgtgtcacttttatacagtcattggaaaattgttgaattgtaaacacggtagccgtgtccgtgtcggtggcacctgattgataagaggatgaacacgggagccgtgtcggcagacttaaagtgttttgagaaaaagtttgttttaataattaatatttcgtcctattagaggtaaaactcactaactacacttttcagaaagtggagaaaaatcgatttaaaggtacaaattgttttttgaattcacctgacttgaatattggaattttttaaatgcaactttaaagaataaataaaaacagatattttgtgccatatttcgtcacaggaactatgatacaatcaatattagatcaatttttgtacttaatgagtttttccatgaacaaaattattggatattgatatcctatcagaggtaaaactcactaactacactttgtacttgatgagtttttccttgaacacaattattggatattgatatcctatcagaggtaaaactctttaactacactttgtacttgatgagtttttccttgaacaccattattggatattgagaacttaatgaatttgtctccataaaatttcgctgacttacaacaaacgaactatcanaattaacaggcaattatgtcacaggaactatgatataatcatgatacaatcaatgttagatcaatttttgtacttaatgagtttttccatgaacacaantattggatattgatatcctatcagaggtaaaactcgctaactacactttgtattttgatgagtttttccttgaaacacattattgaatattgatatccctatcagaggntaaaactcactaactacactttgtactttgatgagtttt

SEQ ID NO: 688 - DNA, 23 bp, Diabrotica virgifera
ggagacgggtcacaggcttcatg

SEQ ID NO: 689 - DNA, 34 bp, Diabrotica virgifera
caaagtgtagttagcgagttttacctctgatagg

SEQ ID NO: 690 - DNA, 509 bp, Diabrotica virgifera
ggagacgggtcacaggcttcatgtgcaacacttaacaccttcagctccaggccaatatctgatatttgccacatgtgtcacttttatacagtcattggaaaattgttgaattgtaaacacggtagccgtgtcggtggcacctgattgataagagaatgaacacgggagccgtgtcggcagacttgaaagtgttttgaggaaaagtttgttttaataatcaatatttcgtcctattagaggtaacactcactaactacacttttcagaaaggggagaaaaatcgatttaaaggtacaaattgttctttaaattcacctgacttgaatattggaatttttttaatgcaacttaaaagaataaataaaaacagatatttgagccatagttcgtcacaggaactatgatacaatcaatattagataaatttttgtacttaatgagtttttccatgaacacagttattggatattgatatcctatcagaggtaaaactcgctaactacactttg

SEQ ID NO: 691 - DNA, 962 bp, Diabrotica virgifera
  modified_base (836)  (933): n = a, c, g or t/u
tgtctttttagtttacttctcttggtttaaaaacaaagcttagctatttatgactgcaattttgatatcgtgtgtattagaaactttagtttttaaccacgatatttaaatattgtggactttgaacaattaaaaaaaaatgtacttggtcactttctgttggcgaaaaaaattagaaatttgacttggtcaatataagcgacaccgtattaggaaattatatttattaactacggtctgtacatagaaaaaaattaaaatctaatcagtttctgtgtcgtcgctttcagaagaagctggttacggtatgaaaactttttttgactactggaatcgatttataccactcatggaactcttgcggaataattttatttctacgcaaggaggctgtttttattttgctctggtatagacaaaagttttttgtataacattggaatgttcttaggaataacagctggtctgaccttgccacatactcaagagtaacgcatttaattttaaccacgatattttgtttccattttaatcttagtctctgttttttaagaacatctgtgcttaagatcgaaaaagtctgaccgtaattcttcaactctgtaggcaccgctcttttcgttgcgtcttgtagaacggactagcttgaaaatattaacagatcgttcattgtaaaaaatggcaacattttcattaacagactatatggcactgtgcattgagtttaccgtttacctccatgtacgaatgtcctttctccataaaattatgctgcaaaatcttagtgtgtgcgttacaacaacatacaaattaatgcggcaatgaacgaatataanaatctctgataagtcagaatataaactgatctctgtgatgccttttgatcatgtgattgcagangttttatccgctttgatcatgctattccnattncagagcttcccacgtgaccattaatctct

SEQ ID NO: 692 - DNA, 27 bp, Diabrotica virgifera
tgacttggtcaatataagcgacaccgt

SEQ ID NO: 693 - DNA, 35 bp, Diabrotica virgifera
gcatcacagagatcagtttatattctgacttatca

SEQ ID NO: 694 - DNA, 697 bp, Diabrotica virgifera
tgacttggtcaatataagcgacaccgtattaggaaattatatttattaactacggtctgtacatagaaaaaaattaaaatctaatcagtttctgtgtcgtcgctttcagaagaagctggttacggtatgaaaactttttttgactactggaatcgatttataccactcatggaactcttgcggaataattttatttctacgcaaggaggctgtttttattttgctctggtatagacaaaagttttttgtataacattggaatgttcttaggaataacagctggtctgaccttgccacatactcaagagtaacgcatttaattttaaccacgatattttgtttccattttaatcttagtctctgttttttaagaacatctgtgcttaagatcgaaaaagtctgaccgtaattcttcaactctgtaggcaccgctcttttcgttgcgtcttgtagaacggactagcttgaaaatattcaacagatcgttcattgtaaaaaatggcaacattttcattaacagactatatggcactgtgcattgagtttaccgtttacctccatgtacgaatgtcctttctccataaaattatgctgcaaaatcttaatgtgtgtgttacaacaacatacaaattaatgcggcaatgaacgaatataaaaatctctgataagtcagaatataaactgatctctgtgatgc

SEQ ID NO: 695 - DNA, 765 bp, Diabrotica virgifera
gttcaaaacagaacaattacactacatttattgattctaacaatctaatagatgttataagatactcgtttatcttaatctgtacaattaactttaattgggtaatgtaatatacaagattaaaagggtaaaagaaaaatttaaaacaatttacatgaagaaaaccaagtaatactgaaaatataaacgatattaagcacctgtatatttaaaaaagtattaaaacgaaaaaacttaatagtaattggaatggcgggaaaaatgtttaaaaagtatttaataagcactgtaccctcacccaaaaaaactatacacatattcaacaatttacataatttattttgtacaggataatatcaaaaaagagaaaacctatctttagttactatctttagtacggccatattaatattcacagaagtgagggatagaggccttattattctttttgataaatatcgctatatttttaaacttacactgatgaacaaaataggaaaatttccttaaaaagatttaatcttctaagtttctgaaggcctgctgaatatcttcatataattgatcaaaatctgccttgattttagcttcaccatcttttacgggatccttaaatttcatactgctaagttgatataaaattccactcattgaatctcttattacgttccaagtgatcttattttctgattgtgcggttgattctacagcgtgtctcgccatgtcgtacaaaccgatcatgtttctcaacataccgacagtttt

SEQ ID NO: 696 - DNA, 594 bp, Diabrotica virgifera
cttatttcgatttgactatgtgatggattgagaccttaggcagagccttaacgttgattgccgagtcaagacctgtaggcatctataaaggcgactatatacaagaattatatgcaagatatgatgatgtcagtgatgctccacctccaccatctcttcctgattggtgtacagaaagtgacgatggacaagggaatggccttgacgatttcgatgattttactgaagatgcaagaaaacgagtagcttcaacttcttcaaataatgatgatacttcaccaaaagctaaaaagggtcgcttctaggaagtcgcatttatggagggagtacctaacgttacccactttgtagaggaacaagcgacccgagattgcaaacgaatggtgcctaggatgtgtaggtgtacaccaaaatggtgttccaggaagtcatgtccgtgtccaatggatatgacaaacattactcttctaaaagaccacccctacagagtttcctgcaaagcagacggccatgaggcattatgaagcttatcaacggagaacacaatgtttatctttttgacagagatgatgaagcttattaaggcggaaggca

SEQ ID NO: 697 - DNA, 884 bp, Diabrotica virgifera
gcttgagtaaaaactgaaatcatataaaagagataatttctattgtgaactaatttttcaaaagtttctacattaagtacatattcattactaaataatggccgaaaacaaaaatccagaggatttggccaccgcaattctccgtaagaaagatcgtccaaatagacttttggtagaagaagcagttaacgatgataactccgtggttgctttgtcacaagcaaaaatggatgaactacaacttttcagaggagacacagtcctactgaagggcaagcgaaggaaagaaactgtttgtatagtattatctgatgatacatgtagcgatgaaaaaattcgtatgaatagaaataatttaagagttaggctttcagatgtagtttctatccaagcttgccctgatgtaaagtatggcaagagaatacatgtacttcccatagatgatacagtggaaggactcacaggaaatctcttcgaagtatacctgaaaccctacttcctggaggcctatcgaccaatacacaaagatgacgtattcgttgtacgtggaggaatgagagctgttgaattcaaagtcgtcgagaccgatcccgctccgtactgtatcgtggctccagacaccgtcattcattgtgatggagatccaatcaagcgcgaagaggaagaggaagctcttaacgcagttggatacgacgaacatccggaaggttgtaaaaaaacaggttgctcaaatcaaagaaatgggtagagttacccactgagacatccctagtctttttcaggggtattggaagtaaacccaccaaaaggtattttactttaccgggtccaccggggaactggtaaaacccctccttgcccccgcaaggaacctaaacaaaact

SEQ ID NO: 698 - DNA, 642 bp, Diabrotica virgifera
gccctttttttctgtccattttatgtcacaagtagggctaaaatgaagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggctttatgtatctgaaaaaacaactgttgtacaagaagaataacttgtatttttgaaataaatttaagtttat

SEQ ID NO: 699 - DNA, 652 bp, Diabrotica virgifera
cacgttgagaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccgcaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatatt

SEQ ID NO: 700 - DNA, 890 bp, Diabrotica virgifera
ggaaaaggaagtgggggtgaataggccaaacaatgacaatggttttagctattaaagatgacgacaacaagtttgatatgttggtaaggaactgtatggctcacgatggaaaaagagctcccatacagttagtcgaccaaagaggttgtgtcacaagaccaaaattgatgtccagatttactaagattaaaaactttggcgcaagcgcttcagtgttatcatatgcccacttccaggcatttaaattccctgactccatggaagttcacttccagtgcaccatccaaatctgcagatatcaatgtccagatcagtgttcagattcttcaggacaacatctccacggcttgcttgatttggtgcatggtccacctgatactggttatggtgctcctccaccgctacctatcgaagcatatttacatcctgggcgaccaagggatgaaaggagatcaaagagagctctcgctgtcgacccggaaaaggaagtgggggtgaataggattattagggttgtatctacaggagatttgacatttacacttgacgaaaacagcaatagcacaactccacccactatggtctttcccgccaaggaggaaattaacaacggaggattaatatgtatgactactccaggttttgcagcaaccttagtagttttattagctatattaatagtatcttgtcttatgtcagctttcctttgtgtcaaactaagaccatttgctgaaaacaactcgcaggtgtcataggatatgccaattcacagaaaacaaagtcaaggagctgcttttactcgtaatattagagcagactgaaaggggttagatcgaaaagaaaacggctacatgcttggtcatataaattaaaaatctttcgacatatgg

SEQ ID NO: 701 - DNA, 888 bp, Diabrotica virgifera; identical to SEQ ID NO: 1
  modified_base (775): n = a, c, g or t/u

SEQ ID NO: 702 - DNA, 953 bp, Diabrotica virgifera
  modified_base (840)  (878): n = a, c, g or t/u
aaatcgtgtctgatataagatacaaaactttggaagaagacgaaatctatactcttctcattattgaagttgttccagaagataccggtaaatatgaatgtgtcgctatcaacaactccggagaagctagatgtgaagctgaatgtgtagttacttcaccatctgctgcccagaaacccgccaaacccacaactcccggtgcggaaaaggctccagcccttctagaacctctcaaagatcagactattaaagaaggacaagctgtcgtgttcagatgtaagatttcagctaaaccaactccagttattaagtggcaaaaggctgataaggtcatcaagccatctaaatacttccaaatgaccaaagaaggggacttctgcacgttaaagatctcagaagctttccctgaagatgaaggagtctacaaatgcgtcgctgaaaatcctgcaggcgctgttagtactcaagctaagttgaaggttattgcaccagaaacgcaagaagttgcaccatcactaaccccaatgaaagacgttactgtacctgaaggtagccctgctcaattcaagactactatttctggaaaacctaagcccaccatccaatggttgagggagggattccttattccagaatcgccagatttccagatgatccaagaagggaacaacgttattctattgatttcctcaacctacgaagaagacactggcttattcacctgcagagcaacttcatcagccggtcaagttgaacaatctgcgaaactaaccgtaaaaagtaagaaatgattgctataaaaatattcttttctaattctcaaattgttaatgtccatcncatgtagttattgttangtatgacagcttncagctggntatttaacacagtataaataagtgatcagttagcagaactcttttgagatagtcatgatattggactaatgggtt

SEQ ID NO: 703 - DNA, 905 bp, Diabrotica virgifera
  modified_base (849): n = a, c, g or t/u
ccttacgcgtccgccaggaacagggaaggagaagcctcagtcacatttactctgaaaatcaagaaaatcaagaagactcaggaaggcaagtttaagatagtcgccaggaacagggaaggagaagcctcagtaacatttactctgaaagtaattacttcagagaaagaagcacctgaggtcttatcacctctagaatctattaccgtaaggaaaggagaaccagttacactttccactactatatttggaaacccggaacctactatcgaatggttgaaggatggtaaacctttaaccagaccaaaattcaaaaaagacggaaacacatacactttaactattcccaagacatctacagatgacactgctacatatacagttcgagctaccaattctatgggtacaatagaaacaagtgcaaacctaactgttgaagaattcccagaaaaccaggaaccaccattgttcgtcaaacgatttgaagagcaaactgtaccacaaaagtctcctctcaccctcaaagccaaagtggttggcaatcctactcctgaagtatactggcttagaaataatgagcctttggaaccatccgatagggtaaagatcaccttcgatggagaaaacattgaactaactattaaagaaaccaattctgaacttgactctggagactacaaatgtattgctgtgaatccagcaggcaaagcctcgcatggtgccaaggtatctattgaggtagatactgtcaaatttactaaagaactgaaagaagtttacgaaacaatagaaagaaagaccatcgaattagaatgtgaaacatcccactcagttagaacaaaatggtggtancacacacggaaattagtggtatggaccatcgcgttgtagtacaagatggacgtacc

SEQ ID NO: 704 - DNA, 426 bp, Diabrotica virgifera
gtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatg

SEQ ID NO: 705 - DNA, 473 bp, Diabrotica virgifera
gtctaggcacggacaaaagggaacgtgcggtatacaataccgtcaagaggatatgatttttagtgctgaaggtattacgccagacattatcattaatcctcacgctatcccctcccgtatgacgattggtcacttgatcgagtgcatccaaggtaaggtatcatccaataaaggagaaatcggtgatgctacacctttcaacgatgccgtcaacgtacagaaaatctccactttgttacaagaatatggttatcaactcagaggcaacgaagtaatgtacaacggccatactggacgtaagataaatgctcagattttcttaggacctacctattatcaaagattgaagcacacggtggacgataagattcattcaagagctagaggaccgttgcagattctcgtcagacagcctatggagggtcgtgcaagagacggcggtctacgtttcggtgagatggaacgagattgtc

SEQ ID NO: 706 - DNA, 677 bp, Diabrotica virgifera; identical to SEQ ID NO: 62

SEQ ID NO: 707 - DNA, 250 bp, Diabrotica virgifera
atggcctgtacgtcaagcaaggccagtcagtgaaaaattacctgccaaccgaaattgacgggcacactgaatctattatgaaacgtaccgcattggtcgcgtttggcttccttctacgaacgtgctggtcgcgttaaatgtttaggtaatattgtgcagctggtaggtaaagcatctctggcagaaacggacaaaatcacgatggtgaagctaaaatcaaggcagattttgatcaattatatgaagatat

SEQ ID NO: 708 - DNA, 250 bp, Diabrotica virgifera
attgtgcagctggtaggtaaagcatctctggcagaaacggacaaaatcacgaaattgacgggcacactgaatctattatgaaacgtaccgcattggtcgcatggcctgtacgtcaagcaaggccagtcagtgaaaaattacctgccaaccgatggtgaagctaaaatcaaggcagattttgatcaattatatgaagatatgtttggcttccttctacgaacgtgctggtcgcgttaaatgtttaggtaat

SEQ ID NO: 709 - DNA, 250 bp, Diabrotica virgifera
gaatacttccgtgatatgggttacaacgtatctatgatggctgactcgacgaatacttccgtgatatgggttacaacgtatctatgatggctgactcgacgaatacttccgtgatatgggttacaacgtatctatgatggctgactcgacgaatacttccgtgatatgggttacaacgtatctatgatggctgactcgacgaatacttccgtgatatgggttacaacgtatctatgatggctgactcgac

SEQ ID NO: 710 - DNA, 273 bp, Diabrotica virgifera
gaagaaagtacgttaatatggttccagggctccaacaagacgagctattcttactgggtcgagaacattttaaaatttttggataagtactacgttcccagcaaaatagctaaaggaaatggccaaattaaaacatgctctcatcacgactatcctactagtggagaagtatgcgaagtcgatgtcagagattgggaagaatgcaacagggatcaattctttaattatcacaagaattctccatgtatttttattaaattgaacaaaatatat

SEQ ID NO: 711 - DNA, 278 bp, Diabrotica virgifera
acatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatc

SEQ ID NO: 712 - DNA, 287 bp, Diabrotica virgifera
aacggttatttggaaggcctgtgtcgtggctttaaatgtgggatcctgaaacaatccgattatttgaatttggtccagtgtgaaactcttgaagatttaaaactgcacttgcaaggcactgactatggaacttttttggccaatgaaccttcacctttgtcagtatccgtcatcgattcaagacttcgagaaaaactcgtgattgagttccagcacatgcgtaaccaagcagtagagcctctctcgacatttatggacttcattacctacagttacatgatcgacaa

SEQ ID NO: 713 - DNA, 250 bp, Diabrotica virgifera; identical to SEQ ID NO: 707

SEQ ID NO: 714 - DNA, 250 bp, Diabrotica virgifera; identical to SEQ ID NO: 708

SEQ ID NO: 715 - DNA, 250 bp, Diabrotica virgifera; identical to SEQ ID NO: 709

SEQ ID NO: 716 - DNA, 372 bp, Diabrotica virgifera
cccgggtttaccatggtagcaaagaaaaatgcgtcgaaaaataaaagagttgcactccaagccctctttaccatggtagcaaagaaaaatgcgtcgaaaaataaaagagttgcactccaagccctctttaccatggtagcaaagaaaaatgcgtcgaaaaataaaagagttgcactccaagccctctttaccatggtagcaaagaaaaatgcgtcgaaaaataaaagagttgcactccaagccctctttaccatggtagcaaagaaaaatgcgtcgaaaaataaaagagttgcactccaagccctctttaccatggtagcaaagaaaaatgcgtcgaaaaataaaagagttgcactccaagccctctctaga

SEQ ID NO: 717 - DNA, 372 bp, Diabrotica virgifera
cccgggcaaatagatggaacccttacaactattgaaatgcagagggaagccctcgaaggagctagccaaatagatggaacccttacaactattgaaatgcagagggaagccctcgaaggagctagccaaatagatggaacccttacaactattgaaatgcagagggaagccctcgaaggagctagccaaatagatggaacccttacaactattgaaatgcagagggaagccctcgaaggagctagccaaatagatggaacccttacaactattgaaatgcagagggaagccctcgaaggagctagccaaatagatggaacccttacaactattgaaatgcagagggaagccctcgaaggagctagctctaga

SEQ ID NO: 718 - DNA, 490 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 719 - DNA, 560 bp, Diabrotica virgifera
ggcgcaagcgcttcagtgttatcatatgcccacttccaggcatttaaattccctgactccatggaagttctccatcaggggccaaaaggggataccaagccattaccggccactcatccacagctttagcatggtacatatagtgatcccaaccgtgcacctgactgtgacccaactcaatgtgtaattccggactgtttctgctcagcgcccgccaccagttagcgccgaagtacaaaagggattggaccttatttttgctggtatcagagctcaacaggcaccacgtgctcaacgataaaagactggtcaggaaggcacattcctttttgccttacttattcaaggcagggtgcatacagagtagccacgtaacaaatagcacatagcgaagtgttgtaccagcataatgtataagctcctgtacttaccaaaggctcgttggcagatctagaccagttggacgaattggttattgagtactgtggtgcagcgccccctttatggcagatgaatgtctgatggccataccagacatcgaaggtattgattacaccacc

SEQ ID NO: 720 - DNA, 372 bp, Diabrotica virgifera
cccggggctaaaggaaatggccaaattaaaacatgctctcatcacgactatcctactagtggagaagctaaaggaaatggccaaattaaaacatgctctcatcacgactatcctactagtggagaagctaaaggaaatggccaaattaaaacatgctctcatcacgactatcctactagtggagaagctaaaggaaatggccaaattaaaacatgctctcatcacgactatcctactagtggagaagctaaaggaaatggccaaattaaaacatgctctcatcacgactatcctactagtggagaagctaaaggaaatggccaaattaaaacatgctctcatcacgactatcctactagtggagaatctaga

SEQ ID NO: 721 - DNA, 372 bp, Diabrotica virgifera
cccgggctccatgtatttttattaaattgaacaaaatatataactgggagccaatgtattacgatgctccatgtatttttattaaattgaacaaaatatataactgggagccaatgtattacgatgctccatgtatttttattaaattgaacaaaatatataactgggagccaatgtattacgatgctccatgtatttttattaaattgaacaaaatatataactgggagccaatgtattacgatgctccatgtatttttattaaattgaacaaaatatataactgggagccaatgtattacgatgctccatgtatttttattaaattgaacaaaatatataactgggagccaatgtattacgatgtctaga

SEQ ID NO: 722 - DNA, 1000 bp, Diabrotica virgifera
caagcccgccaaaatgcgcgaacatctggaactcttctggtctcgagtgaatatccccaaagttcttaggaatgcaatgcttcctagacgtcgtcgagctggctctgaaactgagccccaagttatagtaggtaacgataattattggacgtggcattaggttatagggaaagtgtcaatctgtctcaaattcgcacatttgtggaaatggactcgcacgcgcggcccaacgacggcttcaacaaacacaggcgcaagtcgacgaagtcgtggatatcatgaaaacgaatgtagaaaaaggtatggcaggaaagaaatgctgaatccgccattgaagctcttaaagaatatgaaccagaaatgggcaaagttgtccgacaagacaaatccggtattcagaaaatccgggcatagcaaacatgccaaacacacacacgcagaaaggaaatatcagtcagactcagaatcagatagtgatctggaatggattggacacagaggtgaatcagaccagaggacgttcgggggtatattaaaaataacgttgtgtgcgcacttggaaccgaaacaagcagaccatcatccgcagctcagtgcgtagccgaatgtggccgtgcacactgtgcatttgtaggacaggtgtgcgggtttcaacgtcatgttatgatcccttgcatatattgatggaaaaacacgccaaagaagagagcagagtattaaaaggagtattgccaggtacatagaccagcaaggaactgtaatcaaaatgggcgatgaaaagaaggccagcgatagcgaacacattaatctcaaagtacttggtcaggataatgcagtggtgcagaaggtcagacctctcctcaacgtcacccgtatcgaggatgagattgccaaacttgaagagaaagcccaaaaagcccaacgaacacggcgtagacgaaacatcttgtgtagttattgtagaaggacaaaccagcacaccagaacaacaagaactagc

SEQ ID NO: 723 - DNA, 478 bp, Diabrotica virgifera
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctccgaagtaatgtacaacggccacactggacgtaagataaatgctcagattttcttaggacc

SEQ ID NO: 724 - DNA, 584 bp, Diabrotica virgifera
cacttgacgaaaacagcaatagcacaactccacccactatggtctttcccgccaaggaggaaattaacataaagaacaaggagaagccggtaattacaaagctgcatatgaaaccggaaacaacattatcgctgaagaaggaggttacttgaaggcaaggatgaaatggtaggaggacaggatagcaaccaaatgaatacggcagcgagggaaaatggtattgttgccacatggtagactcctgttctaatgttcaaactggagatcaatttgcaagactactcagacacaatttcaacagacatttgaattcaaaccgagctccgttgggtccagccacataggactaagtgtggagggttcattcatcaaaattcgctttatgtgcacacatagcacataagcatacatggcaaatatgcctatccatccagttgtcagctaacagaagtgcccttatggagggtgttttgaagaacacgctggcgaatgtgagttgcagatgggctcaagaatacaccgctattgaccaggatctcgcttcagaataattccatagaaaagctaccagcccatgcatttaa

SEQ ID NO: 725 - DNA, 869 bp, Diabrotica virgifera
ccgaagtgagatcggagccaaaaagcattggttgcttgacggtccaatggaaaacgaacgagaagtggatggcttcagcaatgctcggccaggctgattgctctttattttgacactggaatgtacagcgaagcgctacaactggaatcgaccttactgactactcgtctacgatatcgccaaacatctgacatacgaaaacgttgaacgttggttgcgcgaattgcgccattcttttctcaggtaccaatgttgctgctggtaaagcacgtggtattgttattggaactggtcttaacaccgccattggtaaaatcagaactgaaatgtccaacgaaattgccaacactaactcaagacagaacatccgtaagttgataaaggatggtcttattattaagaagcccgtagctgtacattcccgtgccgatacctacacagaaagctatattagtaccattggcgtagattttaaaatcaggacaatcgatttagatgggttacaaaaggataccaatacaagatgagagcagcatatgctcactttcccattaactgtgtcaccactgaaggaaacacagttatccagtttgcaagctctctggcagatttcagtcaaatcggcaccagaaaatccatgagttactttagcaatgtatacaagatctacgtctttagctacaggcgatttccgatgaaatagtggcattaggttatagggaaagtgtcaatctgtctcaaattcgcacatttgtggaaatggactcgcacgaagaaaaagtttatcaggccgtgagagaattaaaagttcaaggaggtatcggttcgtgtgtatcacttaacgtgaagagccccttggtttccgacac

SEQ ID NO: 726 - DNA, 737 bp, Diabrotica virgifera; identical to SEQ ID NO: 586

SEQ ID NO: 727 - DNA, 867 bp, Diabrotica virgifera; identical to SEQ ID NO: 614
  modified_base (771): n = a, c, g or t/u

SEQ ID NO: 728 - DNA, 802 bp, Diabrotica virgifera
cgtccgtgataacaaaatcaatcaaagagttgtttattaaatagtattgatagtgtatttgaaaaataataatttatttaaggcgtacaattaataaaaagttatttattgtttatatattatttatggaaaatccaagtatttcaagtcattaaaattcaaataaaagtattattttataagagtttgttccgataaccgtaaataggtatgagtttagttataaagtaaagtgcccatggtgtcataaaatgtagtaaatgctaatgcttcaagtacgtactacatttttgaagatttcactgcacttaaaaagcatttgcctttctccgcagtatttgctactatttaccagcctacatagaagaatgtactacgcttttgaagtatatgcttgtttagtagtattttgcttcagtttaagtgaagttggtgggtggtcgtcttcggcgtaggtatttttttgttacaatatggcagcatttatgaatgtgtgtcatagaaaaatttacaaactaagaagaagattcttaatttttggggtcattcttttatcaaataaaatttaataattgttaagaagattaacaaataacaataattgttcatttttatcctcgcgtaactctttgtcgcttcggatctgagtcactcatttttactcatgtacaattctaataatttggtacgtaaaaatgtgaatttacaaatcacaagcacatggaaaactaattccatcacgattggtgtaatgcagacacggctggcactacgctttgtagtagatacttctggtcagtag

SEQ ID NO: 729 - DNA, 862 bp, Diabrotica virgifera; identical to SEQ ID NO: 682

SEQ ID NO: 730 - DNA, 603 bp, Diabrotica virgifera
gctgctcctgtggcataacggccccgtacctggagaattttacaattttcccggcaaacagaccagctattccaaccctataacacatacacagtctcccgttacaacatcaacttctgtattagctattacttacgataaaggagtattgataaccggagatctggttgcttcatacggatctttagctaggtacagaaattgcccgagggttattaaagtcaatcagaatatcatcttgggagccggaggagactatgctgatttccaatacgtcaagagtttcattgagcaaaaaataattgatgaagaatgcattgatgatggactaaaaatgaaaccaaaatcattgtactgctggcttactagagtaatgtaccaacgcaggagtaaattagaccctttttggaataatctggttataggaggaatccaggatggagtcccctttcttggaaccgtagataaattgggaactgcatatacagacaaagttatatgtacaggttatggagcccacatagccttgcctcttctgagagactctttagataaaaatggagctcttaacttggccgatgccaagactctgattcacaaatg

SEQ ID NO: 731 - DNA, 545 bp, Diabrotica virgifera
ggtactttgggttgtacttgggataaaagacctttttgtgtttccaaatacattgtcatataaattaaaaaagaaatggctgccatcagatctatgtctcgccttcttattaatagatcacttcaaaccactgcaaagaggacctatgccgaccaaatgaacttcacatttgcagctggaaatcaggtttactatactgcaacttcagttaaacaagtagatgtgccatctttctctggtagctttggtatcctccccgcccatgtacccacactggctgtgctaaaacctggagtagtcactgtttacgaagatggtggtaatgttaagaaaatctttgtttccagtggtactgtcaccatcaatgatgattcatcagttcagattcttgctgaagaagcccacccagtagaaaacattgatgtcaatgcagcaagagacatccttaccaaagcccagagccagttatcatctgcaagtacagatgaggcgaaagctgaagcctccattgccgttgaagtgggagaagcgtatcaaagcggctg

SEQ ID NO: 732 - DNA, 496 bp, Diabrotica virgifera
gactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctacggtaaacccaaaagccatggagttaatgaattgaaacctgtccgtaacttacaagctattgctgaggaacgtgtaggaagaaggtgtggtggattaagagttctaaactcctactgggtagcccaagattcaacatacaaatattttgaaatcattttggtcgacccctcacataacgctattcgcaaggaccccaaaattaactggattgtcaactcagtacacaaacacagagaactccgtggcaaaacttcctctggcaaatcatctcgtggtttgggcaagggtcacagatactctcaaaccaagggaggatccaggcgtgccgcttggctcagaaggaatcactgc

SEQ ID NO: 733 - DNA, 512 bp, Diabrotica virgifera
gctgattcgttattctctgtgacaaagtaccaacagttgtgtctttaatatctctcaataagtgttcaacaccaacttcttcagcttcctcagctccgatttcactaggaacatgctcaaatgttttagatgtaggtgaaccgtcatcgtgtacttcttctacagcttgataagcttcagttggtaaacctaaatcttttggtttagcgtctatgataactagaacggaatttggacaataccttctgattaactcattaatggcaatatcattttgatgaagtttggggccggtgtggtaccaacctactactcgttccctggcattaacttttttgaacattccatacatgttttctaagtaatcatggtccaagaaccacacagacttatccttgtcatcttcgtcaaaaggaactgcaaaactgttagaaacatctaagactcctttagcacgccaacagccaagaagaacaccaacaacacgcttttgattgccgattttgcccatg

SEQ ID NO: 734 - DNA, 669 bp, Diabrotica virgifera
gttgacgttgcgtccgaacagagcattacggatctggggaatcaattgttgtgagatgagctcaagacgggcttccagagtattgttgattttgatcttgtttctcaaggccaacagttcgattcctccggtggtttcttgagaaaggtggctctcgtcgtcgatttttagatttacgtctttaccggttatgtccttgtacttttgggagacgttaggcatgatagattttaccaattctctgtcctgagggcgtactctaatggtgatgtccttttcgaagagctgatagagcccttggaggatgagactttccaggatttgtgtatatttgcctgaatctctggttacctcaccaagacgtttgcgagcatcttccaaaacggcacgtacatggtcttcccttactttcaataccttcaatcttgcctggttcaacatgtttgatgattggatttttttctggagttctacttgcttctcttttttctcgtagtactccataatcttgagcctctgttgttggaccagacggcccttttcgatgttgaattcttcttcagcctttgcatcaatttcctcggccttttcattggcttcttgctcaatgaaagccatcatgtgcttgatctgcttttgtacatctgcgtcgctgagagcattttgaga

SEQ ID NO: 735 - DNA, 802 bp, Diabrotica virgifera
gagccaagagcaagtctgaagatggttgacggaaaaccaaacgagagtaccactagcaaagcagccttgaaaaaggaagcaaaaaaggcagagaaggcagcaaagaaagcagaacacaaacaagctgctggtgaaactcaacagaacgttgtagaagaagttgacatatcagttggaaaatatggaaatcttccccttataaaatcagaaactaagcacaacgagaggactttcacctcagtaagtgacctaaataaatccgtgtctggaaaaactgtatggataagagcaaggttacatacttcaagatcaagaggaaaacaatgctttattgttctgagacaaaaagaatttactgtgcaagccattttaaatgtctcagacgtcgtttcaaaatctatggttaaattttcaagtggggtacctaaagaaagtatcctcgatgtcgaagccaaagtatcagtagtgcccaataacatagcaagttgtagtcaacaggacgtggaactagttgtttcacagttatgggtagtgtccttgtctgctccacagcttcctttgcaaatagaggatgcatccagacctgaaaaaccagaggaagaagaaggtttaaatatccgggtaaatcaagacacaaggctggacaatagaattttagacttgagaacaccaactaaccaagcaatttaccgattggaaggaggcgtctgtcggctgtttagggaagcgcttactaagaaagggttcgtagaaatacatacgccaaagatcatatctgctgcttcggaaggaggtgctaacg

SEQ ID NO: 736 - DNA, 579 bp, Diabrotica virgifera
gcagtcccagaatcagtcttaaaacaccgtaaaagacgtgaagcatcccgtgctaaacaactccagtctgtcatcaaaaagaaggcagaacagatcaaaaagaggaaagatattttcaaaagagctgaacagtatgttaaggaataccgtttaaaagaaagagacgaagttaggctagttagacaagccaaaaccagaggaaatttctatgttcctgctgaggctaaattggcttttgttgttcgtattaagggtatcaataaagtagcacctaaagtacgcaaagtactccaactattccggttacttcaaatcaacaatggagttttcgttaagttgaacaaggctactattaacatgcttaggatatgcgaaccttacattacatggggatatcctaacttaaagtcagtaagagaattaatctacaaaagaggatttgccaaagttaatggacagcgtgtagcaattaccagcaatcaaatcgttgaagacaggttgggaaaatctggaatcatttgtgttgaagatttaatccacgaaattttcactgttggacctaagttcaaatatgcctcc

SEQ ID NO: 737 - DNA, 640 bp, Diabrotica virgifera
gttcagaaccaattacacgaataaagcaggcatctgttctattggctactgctctagcacaaagagttttaccagttccaggggggccaaaaaggagaacgccttttggtggttcaataccaagttttacaaatttttcaggatggagtaaaggtgtttcaacaacttctctcaacttttcaatttgttccttgcagccaccaacatcactgtatgtaacatcaggcttctcctcaacttgcatcatagtcacagtgggatcaatttttggaggtagaggaatatgaatttgatacttatttcggtcgactccaactctcatgccttcttctatgtctgtaggggccacagagtctgccaaatctactacgaatttggcaaactgtttaacgtttataatgtatttgggatcatctgtatcagcgttgataattttcgtacaacgggccacttgtaagggttgctcattttgtaaggtttgtttgtcagctgccaaatcccataaagctggtggagctaaaccagtatcagattcttttataccagttaattcatttactcttttgattatcgtttggatatcttcttcacatgttttaattgtctttgtgtattgcccttgtccataggttttaagaag

SEQ ID NO: 738 - DNA, 669 bp, Diabrotica virgifera
ccaccttcaaatgcgtcttggtcggagatggaggtaccggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgttcgacgttacatctagagtcacttacaaaaatgttccaaactggcacagagatcttgttagagtttgtgaaaatatcccaattgtattgtgtggtaacaaagttgacatcaaagataggaaagttaaggcaaagagcattgtcttccataggaagaagaatttacaatactatgacatctctgcaaaatccaactacaactttgaaaaacccttcttgtggttggctaggaaactcattggagatcccaacttagaattcgtagctgcacctgccttgcttcctccagaagtccagatggatccccaatggcagcaacaaatcgaaaaggatcttaaagaagcctcagaaactgcactgcccgatgatgacgaagatttataaactcattaaccaattactaaaactctgtcatcgttccaaagcg

SEQ ID NO: 739 - DNA, 302 bp, Diabrotica virgifera
catcctctgtgtttccgttttgaacttaacttgtatttagtttaaaaaataatcatgtctagaggaagcagtgcaggttttgaccgacacataacaattttctcgcccgaaggccgactctatcaagtagagtatgcttttaaagccattaaccaagccggccccactttggtagcagtccgaggagtagatgctgcggcgtgtgtgacccagagaaagatcccggataagctgattgatcccaacacaattacacatctgttccagttaacagaacacactggatgtgtgatgactggcat

SEQ ID NO: 740 - DNA, 838 bp, Diabrotica virgifera
gaacttgtttaactacttgaagtacattggctggcggtgtttgtggttttagaccaattccaggttggtgaggagatggtattcccatttgaggatttggcaaacctgtactcattgaattagcaggactaacagcacctggtactactgattgcacaccagcaccacccatagtgacattagcaccacctggtataggattcgctgctggtgctgttctagtcataacagccattcttctcctaagtagttgcgcctgttgcaacctttgttgcaattgttgttgttttagtttgtgctttatgtttgaacagaatggtacaggacacttgttttctgggcagtgtttggcatgatagcaacatagagcgatgagttgtttgcaaatagggcaaccaccatttgttttcctcttgcacaatttggtgtgatttgtgactcgtttcatcttctgacagcttggtaaccgacaattggcatctctgcattgacaagcatgtaccaaagaatggatacaacgctgtatagataattttctagcttctcctggattggctttgctatcactaggtgaacttccatcatcaatatccaatccaagtttctccattttgtgaggatgaccttctttctcataacattggatgcacaagtcaaagtcttcacacacagtacaatgataccttgtttccacatgggctttacaactattacaagtatatacaaatttatcttgaccttgattatgcaattcatataacatagacaaagcactatatttggcccttcttaaagaagagaattcataatgtttttcacgggcgagtgttaggaatgc

SEQ ID NO: 741 - DNA, 1301 bp, Diabrotica virgifera
ttcaagttgttcttgtccttcttcgtaggcgcccttaagtctgaacaattcggtggagtagtttctgcattctttctgactggcatcgagttcagcagccaagtcatcaaccttgagtttccattctccaatgattttgtcgaaggccttttgtttcttctcagcagcattggcaatggcgttagcacggtcgacttcgagttgcaagtcttcgacttcagtggccaaacgttgtttggtcttttcaagagctacaaccttctggttgagagattcgatggtttcttcagcctcagcaagacgagcttggagtttcctcttagcttcttcgagttcttcagagcgagcaactccttcagattcgtatttctggcgccagagttgagattcagcgttggctttgctgagttgtctttggatatcagccttggcttcggcttcttcttcaacttgttcacggatgttgtccaagtcgtgttccaagtttctgaatttgccgaggagggtagcgcgttctctgctctcttcatcggccaatctcttggtatcttccaattgagtggtaagggataccttgatcttgctgagttgagatacttgagattcggcttcctcgagttgtctgaggaggtcggagttttcaatagacaacttcttcttggcggcatcgaagtcgttaagagtgcggttggtttcgtcaagtttgccttggacgtcgttgagttgttgtcccaattgtttggataccttttctatagcggccttttcgttggctaagtggtcgactgaagcacggaggtcattgagttcaccgaagtattgagacttttctttctcagccttggctttgagtttgttgagttggtcaatttgttcacccatttctgaaacagcgtcgttgtgcttcttgcggaggttagcaagagttccttcatgttggatgttggattcttcgaggtcacgacggagtttggcgagttcggcttcacgtttcttgttgagttcgatttgggctgaggtagcaccaccggcttcttcaagacgttcgccgagttcttccaattcgcgggccaaatcagcgcgttgtttctcagctttagcacgggcttgacgttcagcttcaacttcctcttcgagttcctcaatgcgagcctggagttccttaacttgtttttgttgtttaccaacaacggattgttcgtcttcgagtttggcagtgagtgatgagatttccttgtctttgcgttggatggtttgttcgagttccttcttgttgcgttccaagtcagctacagcctctt

SEQ ID NO: 742 - DNA, 824 bp, Diabrotica virgifera
cacctccaaggaaagtgtctccattggttgattttacttcaaaaactcccttttggatttccaagatagatatatcgaaggtaccacctcccaaatcataaacagcaataactttatcctctgttttgtccatgccataagctaaagctgcagctgtgggttcatttatgactctcaaaacattaagcccagaaatttgtccagcatctttggtagcctgacgttgtgagtcattgaaataggcaggtactgtgattacagcattctttactttggtgtttaagtaggcttctgcagtttccttcatcttaaccaaaacaaatgctcctatctgactaggggaatacatttttccatcgcttccctgaacccaagcatcaccatttgatgctttaactattttatatgatacagttttcatatcttttttaacttcctcatcttcaaatcttctaccaatcaaacgtttagtggcataaaatgtatttgcagaatttgttacagcctgtctcttagcgggcataccaactagacgttcattatctttactaaaggcagctactgaaggtgttgttctggaaccttctgcattttcgataactttggcttgtttaccttccataacagcaacacatgagtttgtagtacccaaatcaataccaataacagcccccttgattccttctgatttgtgtcgtaattgaatgtcatattttgggtttagagcgtacagggaagatctattatttgacaaatggttaaaatttctgtttccagctttttcgaaagtgattttcgagcaatcgagggctttcctgctaagg

SEQ ID NO: 743 - DNA, 704 bp, Diabrotica virgifera
tgtagacctctttgccaaggtatcggctggagatttaaatcctataaatgctactattggtggtattgtagcccaagaagtaatgaaggcatgttctggaaaattccatcccattttccaatggttctactatgatgccatagaatgcctaccacaagataaatcagaaatcactgaagaactagctgcacccactggtagcagatatgatggccaagttgctgtttttggaaaagaattccaaaagaagttagcatcactgaaatattttattgttggtgctggagctattggttgtgaattgttgaagaactttgctatgatgggtgtaggaacacaaggagaagttacagtaactgatatggatttaattgaaaaatctaatttgaacaggcagttccttttcagaccacataacgtccaacaaccaaaatctgccacagctgcaaaggtcattaaaaagatgaatcctgatatcaatgttgttgcacatgaaaatcgtgttggacctgaaactgaaagtgtctacaatgacgatttctttgaaaagcttgatggagttgctaatgcactggataacgtagatgctagaatttatatggatagaagatgtgtctactaccgcaagcctcttctagagtctggaaccctaggaactaagggaaatactcaagtggtggcaccttactgatacaacagggggg

SEQ ID NO: 744 - DNA, 971 bp, Diabrotica virgifera
gacgtgccccttaagtcaaaataccaaacgagaatccggtcgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacagcatccagctgcaaaaagtatgattgaaattgcaagaacacaagacgaagaagttggagatggtaccacctcagtaattgtcttagcaggagaaatgttagtggcagctgaacagtttttggaacaacatattcatccgacaatcataattcgccagtacagacaagcactcgaagatatgattcagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattattagaagaaaatggcagaactgaagttgatatcaagaggtatgccaaagtcgagaagattcctggaggatccattgaagaatctaaaattttaagaggtgttatgcttaataaagatgtaacccatcccaaaatgaaaagatatatacagaatccgagaataatacttttggattgtgcattagaatataaaaaaggggaatctcaaacaaacgtagaaatttcagcagaaacagacttcaccaaactattagaactggaagaggagcatgtcaagcgtcaatgtgatgagattattgcactcaaacctgacgtcgtcttcacagaaaaaggagtatcagatttggcccaacactttttactgaaagctggtattaccgctatcaggcgtgttcgaaaatctgataataacagaattgccagagcctgtggag

SEQ ID NO: 745 - DNA, 1049 bp, Diabrotica virgifera
ggaagaggctagaagattggctgctcttcagaaacgcagagaactgagagctgccggaatagaagttacatctcgtagaaagaaaaaacgaggagtagactacaatgctgaagtaccgttcgaaaagaggccagcgattggattttatgacacgtctaatgaagtattagatcctatggctcccgatttttcaaaaatgaggcagcaacacttggatggggagctgagaagtgaacaagaggagagagaacgtaagaaagataaacagaaactaaagcagcgcaaggaaaacgacattcctcaagctatgttacaaaaccaggaaccagctaagaaacgatccaagttagtgcttccggaaccacaaatttcagaccaggaaatgcaccaagtggtgaagttgggcaaagcgagtgaagcagctagggaaatagttacagaaagcggtgttgaaaccactgacactttgttgaatgattatactttcaatcctcaagcggctgctacaccaaggactccggcgccccagactgataggattttgcaagaagctcagaacatgatggcgctcacacacgtagatacgcccctcaaaggcggcattaacactccgttacacaattcagatttcagcggggtcctgccccaagctcagaccgtcagcaccccgaataccgtgcttgctacgcccttcagatccagtaggagtgacggagctggcactcctggcagtagcgttggatttatgacgcctagaagtggcgctttggtgcctgtggggaagacgccggtaggaatgacgccttcggttagggataagcttagtattaatccagaggaagcaatggacgtaggaagcacaccagctgagcacagaatgtaccagatgtcgatgaaagatcaattaaaaatggggttgagcagtctaccacaaccgaaaaacgactatgaaatcgtggtgcccgaaaatgaagaccaggaagaacccgagcaagctcagtcacaaatgatcgaagatcaagctgatgtagatgcacggaaacaagaag

SEQ ID NO: 746 - DNA, 547 bp, Diabrotica virgifera
gatggagtgctaagacaatgctactcgtgtgtgattgtagatgtttcccacttgatccctgcttctgtttcctagatacatcttgtaattgggctatttgttgattcaagttgctaagatcaccttttatgatatatgtgagttcttggatttctgatgttttgtcgtcaaataaagattttcgttttgccaacaatgtcaacttttccaatttagcataagtgctagctatatgccgtcccacattcttcgcaattagcataaactcgctatgactttgtataaccctcgatttcttcgggtccctagcagctactgccctagcaatgttcctgccttgtaatgtctgtatagtatttacaaattcactagttctgtctctggcagtcatgactaattctggttcagtgtagtcttcgatataatcttcctctaaatagtagtcagatgtaacattgtttggatacaccgtgtgtgactgattcgttttaggctgagggttagtccaataattatcgttacctactataacttggggctcagtttc

SEQ ID NO: 747 - DNA, 508 bp, Diabrotica virgifera
cacaaattctactatatcctaaagaagccatcgttaagactgctgcgagaccgcaatcaccgactaagaagcgtggcggagcacctcacaagcgcctttccaccaacaaacacgacgtcgccgtagtcccactacctcgagcgccttttaccattaccataccaatcacgatttctacgttttctaacctgcaagataatgtctgctactattttgacgcgaattaatttagcagttcaaaatttgaagcatcatgtacttaatacttttggaagaggttttccaccagatgcactttgcctagcaggaatagaattaaacaaaagtcctcagaatttgcccaaattttctattaaagatataataggcgagggatttttatgggcagttcctaaacataggcggtcagtagaaaaacgatggaaaagaaaatttggtgatccctattatgtcttgaaaattttattgcctagaaaggatttaaggacctgtaatgtttgtggtgatg

SEQ ID NO: 748 - DNA, 788 bp, Diabrotica virgifera
cgtataacctaatcctctttcttggcatcaactttgcctcccctaatcctaccagttctcctggcagcgataagaccgactttacgaccagcagatgttcctctcttaactgtggatgctttaccaatgtgttgatggttaccacctccgtgaggatgttcaacagggttcatagcaacaccacgtaccttaggccagcagttacgtttaactttgtatttgtggtaagcacgacctgcttttaagattggtttgtcaatacgaccacctccagcaacgatacccaccatggccctgttgtttgatggaataactttcttggctccagaaggtaacttaactctggttttctttgtgtcgtgattatgggcaattacggtagcatagtttccagatgcacgagctagccgaccacggtcaccagttttttcttctaagttgcatacaatggtaccttcaggcatagttcctacaggcaatacatttccaatttgaaggttagctttctttccacagtacaaaaattgtccagtgtacattccttcgggggcaataaacaattccttcctagtttggaacttgtagggatctctgaaatgtactactgccaatggagcaccacggccagggtcatgtatgatatcttttacaacacccttaatgtaaccatgtctttctgagaaatctaaataacgtagtttgggtgctcctttcctcttttttgtgtgggatttgaatacagatcccgcacctttacgttgtgcacgaattacacgacccattgtaga

SEQ ID NO: 749 - DNA, 752 bp, Diabrotica virgifera
gaggcgtaggcaaggaaaaactgattactatgcccgtaaacgattgattgttcaagacaagaacaaatacaacactcccaagtaccgtttgatcgtacgtatctccaacaggaacattacttgtcagattgcttactcccgtattgagggagacaagattgtatgtgctgcttactcccatgaattgcccagatatggaatcaaaactggtcttaccaactatgctgctgcctatgccactggtttacttttggccagaaggctcctcaaaaaattgggacttgacaatttatacagtggcaccactgatgttactggggacgaatacaatgttgaagctgctgaacaaggaccaggagcattcaggtgttacttggacacaggtttaaaccgtaccagtactggcgcccgtgtctttggagccatgaaaggagctgtcgatggaggcttaaacattccccactctacaaaaagattccctggttttgacagcgaatccaaaagcttcaatgctgaagtccacaggaatcacatttttggcatccatgttgctgattatatgaaatcactggaggaggaagacccagaggcattcaagaggcaattcagtcaatacattaagctgggaattaatgctgaccagattgaaaatatgtacaagaatgcccatgctgccattcgtgcaaatcctgaattagaaaagaaggctgaaaaggctccagcacctgcaaagagatggaaccgtaggaagc

SEQ ID NO: 750 - DNA, 436 bp, Diabrotica virgifera
ccacataagggcaaacttgttagtattgtagacgtaatcgaccagacaagggttttagttgatggccccaacagcaatgtacccagaggacagcttaggttaaacgaattgcatttaacaaagttccgcattaggtatccattttcagctccaactcgtgttgtaagaaaagcatggactgatgctaagattgatgaaaaatggaatgaatctgtctgggccaaaaaagtagctgccaaggaaaagagatcacaactcacagatcttgaccggttcaaacttcgtagggctcgttcacgaagaaaccacatccgtacagcaactttccttgctttaaggaaggccgcatcaagaaacggtttcctctatggtaaaaagaagatggctaaaggaggtgacaaacctaaaccaagcaagaaggcgaagaaagaaaagc

SEQ ID NO: 751 - DNA, 1072 bp, Diabrotica virgifera
tccagttcaaattccgtgccaaattctaccccgaagacgtcgccgaagaactcatccaagatatcactttacgcttattctacttgcaagtgaagaactccattctctccgatgaaatctactgcccgcccgaaacttccgtccttctggcttcgtacgccgtacaagccaggcatggagattatgataaatcaactcacacgccaggattcctagccaacgataggttgttacctcaaagggtaatggatcaacataaaatgtcaaaagatgaatgggagaatagcatcatgacctggtggaaggaacatagaggtatgttaagggaagatgccatgatggagtacttgaagatagctcaagatctagaaatgtacggagttaactatttcgaaatacgtaacaaaaagcagacagaattgtacttaggtgtcgatgcgcttggacttaacatttacgaaaaagatgaccaacttacacctaaaatcggtttcccgtggtcggaaatccgcaacatctctttcaatgataggaagttcatcatcaaacccatcgacaagaaagcacccgatttcgttttctttgctccacgcgtgcgcatcaacaagagaattctcgctctttgtatgtgcaaccacgaactgtacatgcgcagacgtaaacctgataccatcgacgtgcaacaaatgaaagcgcaagcgcgtgaagaaaagatggcaaaacaacagcagaaagaaaagctccagtctgaaatagcggcaagagaaagggccgaaaagaaacagcaagagtatgaagatagaatcaaagccatgcaagaagagatggaaagaagtcaagctaactatatggaagctcaagagatgattagacgattggaggaacaattgaaacaattgcaggctgtcaaagaagagatggaaaagagacagaacgagttacagtccatgatggagcgtttggaagagagcaagaacatggaagccgccgagaggcaaaaattggaagaggagatcagggccaaacaagaggaggttctacgtatccaacaagaagtcgaggctaaggacag

SEQ ID NO: 752 - DNA, 864 bp, Diabrotica virgifera
gaatactatgaggacaccttcgccttggtccaaaattccatgaaacttggcatctaaaatcatctgtgacaatttcttctctacttgtagtactgggagttttatggtttttgctacatactctacttgtaccctagaatatggttcgataattctgcaaaggttctgctccaacatattgtcatacaacgttcctaaatgtgctctaacaataacatcatcttctaattcatgtttaaactgttttacagcttgttggaaatctgctagtgatcttttgtgtgcagcctgtgcaactgatttcatagcctctatatcttgaccagcgtatttaaaggccaatttaccactaacgatttgttggacgtcttccggactgtttatcatgatttttgacaaaagcatgtatttaagggctgtgagggcttttggggattcaacactatcaaaaccttcaaaagcttcataaaaataagaataagctgttttgaaatccttctcatctgcagcgtgtaatactccggattgtaaatctaaagctgcctgcatctttggagggcaatagatagcgttagctgtggttcgtgctgaagttagtgcagctctagccttcggtaaattacttaaagcatgatatgttttgctttcaagtagttgtacttccaccaacaaatttttgtcatccaacttttttaactctttcagtaaggtcgattccagttgtagcgcttcgctgtacattccagtgtcaaaataaagagcaatcagcctggcttcaagggactgacgtagaaaagttcttctctcttcctttgcccattctatacattctttgcagagttgtacttcgataccaataccagc

SEQ ID NO: 753 - DNA, 383 bp, Diabrotica virgifera
tcatcggtaaacacgaaataattcctagccatggtgcgtatgaatgtattgagcgatgctctaaaatccataaacaatgctgaaaagcgcggtaaaaggcaggtccttatcaggccttcatcaaaagtagttgttaagtttttaactgtaatgatgaagcatggttacattggcgaatttgaaattgtagacgatcacagaagtggaaagatagtagtaaatttgacaggaaggttaaacaaatgtggagtaatttcccctaggtttgatgtaccaattacacatattgaaaaatggacaaataatcttttaccttcccgtcagtttggatatgttgtgcttaccacaagtggaggtatcatggatcacgaagaagctagaag

SEQ ID NO: 754 - DNA, 923 bp, Diabrotica virgifera
gcaataccaggtaaaccaacattctgtctggcttcaacaatacgttccatggcagagttggctagaccgtagttagcttggccagcgttaccacgtccacatgaaactgatgagaagttaacgaaatagtccaaattgttcgccatttctctggaaaccatatctaacattttgctgccgtcaacttttggtttgcagacagtcttaaagtcagcttcagattggttttccatcattgcgtcacgcaagactactgccaggttaaagattccaccaacgggtcctaattcactggcttctgtaagaagtcttctggcacctttgtcagttgttgcatcggctgtagaaacaagtacgttcacacctttttctctccatcttctgatacatagtgattggtatccagttttaattccacttctggaggtcaacaccattttcttggcacctctagtaaccaaccagttggctaattcaagaccaaatccaccaagacctccaaccaaaatgtaactcttttcaggatccatgtatgttctgggaatagcgctgacagtcttaacagctgggcgagtggcagttttaggttcttcttctcttatttggagcaaaactttaccaatatgtttacctgaagccataaatctaaaggcttgttctacttggtgttcattgtatacagtctttggaagtggccttacagctccgctcttaattccttcagttaccaatctcattacttgtctcttctgaggactgtctgaatcaaagagagcgtcaagaaggattccgtggaaagtagtgttcttcaagaagatgctcattcccaacgcagaattgttagaaagatctacttttccaatttccaagaagcgaccaccaattgccaaacatcttacagaagcctggagttggtgagcagc

SEQ ID NO: 755 - DNA, 1312 bp, Diabrotica virgifera
cgtggcatgaactacgattctctttcaagtccgccatgttgacattcgacaacttttttgggaggacaggtgaatgttatagcgtttttcaaagtgtaaggtgtttattttcaaaaagtttataaaataagcaatcactatgggtaatgtgtttgcaaatttattcaaaggcctctttggcaaaaaggaaatgaggatattgatggtaggactcgatgcagctggtaaaaccacaattttatataaacttaaattaggagaaattgtaacaactattccaacaattggatttaatgtggagactgtagaatataagaacattagttttacagtatgggatgtaggtggtcaagataaaattaggccattgtggagacactatctccaaaacacacaaggcctaattttcgtagtagacagtaacgacagggaacgtatcactgaggctaaagatgaattaatgcgtatgttggccgaagatgaacttagagatgccgtacttctcattttcgccaacaaacaagatttgcccaatgcaatgaacgctgcagaaatcaccgacaaactcggtctccattcactacgcaaccgcaactggtacattcaagctacctgtgcaactagcggagatggtctctatgaaggtctggactggttgtccaatcaattaaagaacgccaatcgctagaacataggaaaagagaggagtgcgcaaaaaagtgtgcgagtgcagatggtttttttcttgtactcttgtcgtgtctactacctcgcgcgcgcgcgaaacgtttcgtataccatatgttgcaatttttgtgtccgatggggaaattcgtcatgtttcactttgggggttataaaattggctgttggcgacaagtggtgtatgaggtgaatccgaaaatagttttaggcaatatatcatatgaatctcagctttctttaggttgagagttgtttttgtagtaaaagaaccttaaacatccttcattggcgatttattattttttaactgcatgaaaatcttagttttaatgtttttatataacacttttagattgtactaacttttaacattccacaaatttctcataaaattgtgatatcttttctaatacctcttatatcaatgaacttatttttgcaagccaaaatattttcttagaaagtaattttgtatcatctatataaatttaattttgggaattcaattaaagactttaactggcaaattttaaaatgttaaaggttctagtcacgtatttagtctggacttgcactttatagcacttgtcgcagaaagcatctaacc

SEQ ID NO: 756 - DNA, 442 bp, Diabrotica virgifera
taggttgggcaggttgtctcctaagttctactttaacgttcttttctttagcttctttacgtagcttttcgttggattttactctttgcaagaagtcttgacgacacttggagtggtttacatgttcaatacggagattgattcttttggggatgattcttcctcgaacccttttgtttacaattacacctaatgcatgtgcagtaacgttgaaaacacgtcctgtcttaccatggtacactttgtggggcatacccttttgaactgcaccattacccttgatatctacaatatctccaactttgtagactctcaaatatgtggaaagtggaattacaccacgttttttaaacttgcgggcaaatagatccctggttcctcggcggtaacctttagagttggtcattttgtaccttccaaatcctaagaaacacagtaaacc

SEQ ID NO: 757 - DNA, 404 bp, Diabrotica virgifera
gtgcgagaacttcactatctattcaacatgcagttgtgtttaagaggaaccgcaactcatttccttgaatgccaaggatctgagactgttggagaaattaaggaccgtattgcatctttggaatcgcttaaagcatccgaaatcagtctttatgctgctggagttccagtttctgaggaaaggttggtagccgattttgagaacacagacattgaattgactgttggcttgcctggtggtaaagttcacggatctttagctcgtgcaggtaaagtaaagggacaaactccaaaagtagaaaagcaagaaaagaaaaagaagaagactggtagagctaagaggcgtattcaatataacagaagatttgttaatgtagttgcatctttcggacgcaggaggggacc

SEQ ID NO: 758 - DNA, 747 bp, Diabrotica virgifera
gtcatctcagtttggtttattgttgggtgtaatgtttaaataaaataattattattttgtaaacctgtgccattaaacaaataaagcgatggtgctaattgcagcagcagtctgcacgaaagcaggcaaaacaattgtgtctcgacaatttgttgaaatgaccaaagctagaatagaaggtttgttggctgcctttcctaaattaattcctacaggaacccagcatacatttgtggaaacagattcagtacggtatgtttatcaacccctagagaaactgtatatggttcttattacaactagagctagcaacatattagaagatcttgaaaccctccgtctattcgcaagagtgattcctgagtactgcaaatctttggatgaaaatgaaattgcagagaatgcattttcacttatatttgcttttgatgaaatagtggcattaggttatagggaaagtgtcaatctgtctcaaattcgcacatttgtggaaatggactcgcacgaagaaaaagtttatcaggccgtgagacagactcaagagcgcgaggccaagaatatgatgagagaaaaggcaaaagaacttcagagacagaagatcgaagcggccaaaaaaggagggaagacctcgtttggtagtagcggtggctttggcagctcgacaggttatactcctacgccatctgttggtgatgtagctaaccagacaaatgatgttaaaacttcttcatacacaccagcccctgc

SEQ ID NO: 759 - DNA, 1285 bp, Diabrotica virgifera
gcactgattcgtttatttcacctagaagattgaaagccgattctactccatcatccgcaacctgattgttatctctggctttttgaacttcatcagaatcataagaaagaataaagtagctatcttctgtggccaaacatactaatttaccactatctgaccagtaaactgcttttggttgtatctcgattcttctgactaaatcgagagtttcccaatcatagaaagtcaaaccagaaaccgatttgactcccaaaaggtatccaccgtatataccttcagctccaaaatcggacttaaaattcttcttctctttgaaattcttaaaaattctgatagtagatccggattctctgatggcatattcgctggaatcttgagcccacacaaattcttgtgcgctaccaaacgctttgtttcttaaagccattgctgtgtagattatgtattctccatccccacagacaacaacaaaacggccattgggattgtgttgaattgtctgagggtatatctcgcaagcacccatatcttttacagaaactggaaggcgttctccatctcttatttccgcaccttcagctaacgccttgagatttgcctgttgaagttcagagtgtctggcccaaataattttgcctccactggcatccatactaacagctggttcttctctaccaactttaaccaaaatgctaccttcatcataacccaatgccacgttattggatccctttaggcagaaaatagtccatactctttcaaagccataatttaagctactttctaacctatgggtgttggcatgccacactctgacagtaccatcttcacttccagtaagagctacaggaagttctggatggaaacatgcagcggttacattttgagcatgtccttccaaagtttgaacacaagttttgttttgataatcccagatttttactaatctatcatcagcgcctgagattaaataaggtttatctccaccgtgataatagtccacacagttaacgcctttctcatgaccttctagtgtgaaattcgctgtggacgctcccaattgccatactttcaatgttctatctagggatgcactggcaaatgtgttgttgtcttttggatttatggcgatttgcataatataatgagtgtgtccttcgaaaacttgctgacaagcccatgctttttcccaattccaaagcttgataagcatatcatcactacttgttaatatataaggttgtgtagggtgtacgacaatacatctcacataatccgaatg

SEQ ID NO: 760 - DNA, 442 bp, Diabrotica virgifera
ggaaaacaacccaaagaagagtccaactatctcttggacctcaagttcgtgaaggtgaaatagttttcggtgtagctcacattttcgccagtttcaatgatacatttgttcatgttactgacttgtctggtagagaaactatctccagagtcactggaggtatgaaagtcaaagctgacagagatgaagcttctccctatgctgctatgttagcagcccaggatgtagctgaaaaatgcaaaacattaggaatcactgcactccacatcaaattgagggctacaggtggtaacaaaaccaaaacccctggaccaggagcccaaagcgcactcagagctttggctcgttcaaacatgaaaattggtaggattgaagatgtaactccaattccatctgattccacacgtaggaagggaggtcgccgtggtcgtagattgtagac

SEQ ID NO: 761 - DNA, 959 bp, Diabrotica virgifera
cgatgttctgccgtgactgtctcagtctgttttagactaacagagacagccacggcaatattcctttccaatacccactctcctgatcaacgggtggctttaatgctttatctaatccttctattctgtggtatccatggcagaagtttccacagctgggactgcatccctgggctcgtcccccgcatcatctctcaacggatctgcaggaaggtcctcaattgcagcagctgcagctcctcctcctctacgttcttcaccctcaataagggacaagtagggggaagtttcttcttcttcgaggattttaaaggtctgacctttgccagtgtatcctatggagacattttttgttgtgaggtcaacctctggaggtagagtatctctaagagccctcaatccatgtttgataagttcttctaaagaactagatggcaattcatccagatgtttttctaagtatgtcctggcactctgggatcgagctccaatggacatagctttgcaatcgtagaaattagcagaagggcacgtttggtagatatgagaaccagattcgtcataaccagctactagaagacctacgccaaatggtctgcggtcgtatctttgggtacatgtctgcattttgttacctaaaatactgataagcctattcaatggcatataagtatccaaagagtacttataattcaagcattcgtttcgcatatatctactaaggatcctagcatcagctgtaagtcccgagatggtgataccaatgtgatcgtctatgttgataattttcttctggtaggcagacagttctgaagaagccctcttcaaagcgataagtacagcatgagttttacttttcagtcccactgtggctgaacctaggttaactgcttccatggcatattctacctgatgcagacggccctgggggctccacactgtcacatcactatcgtatt

SEQ ID NO: 762 - DNA, 429 bp, Diabrotica virgifera
ccttggcgggggctgtagccttcttggctgtctttgtgctctttttctgttccttagcggcacgaatggcttgctccctttgggccttccttacttcaggcctttggtttctcttggccatgatatcatttaaagaagcacctacaatagccctttggaatttctgtgtccttctggtacgttttttggtggcttcttcctcctgacccttcttatgtttacgtctgtacaagacagtccatgttactttacgggggttccttttcatcaagtgcgccctttcacattttgagttgaggaaagtgaaggtctttccatcaactttaaccattgttttgccatgtccggggtaaattttgtacccgctgtaagcacaaagtccgatcttcattttggaatgaaattactacttaaatgacagatgacaac

SEQ ID NO: 763 - DNA, 828 bp, Diabrotica virgifera
cagtgacaggacggtgattcttagccaagtagtcagcaaactcttggtatggtgtcttagccaaagccatatccttccacaaatcaggtgtcaagtaagcataggtctttgcgatggctgcgtatgtagctttggcaaagttacctaaagtaccagtggaacctctagcggatgtgtagcaatcttcaataccagccatctgcagaagtttcttaggaacaggggcagaaacgattccggtaccacggggagctgggatcaaacgcacagtaacagaaccacattttccagtaaccttgcaaggtacagtgtggggttgaccaatcttgttaccccagtatcctcttcgtactggaacgacagacagtttggctaaaataatagcacctctgatggcagttgctacttccttgctgcattttacacctaatccaatgtgtcctttgctatctccaatggcaacaaacgccttgaaacgtgtacgttgaccagcacgagtttgcttctggacaggcatgattttcaatacctcatcattcaagtctgatccaatgaaatgatcgatgatttcgaattctttgattggcaaagagaacaggtagatttcttcaagagaacggatctttccatccttgactaaacgtcctagcttggttactggtacccattctttttgatcttcctttccacgaccacgtcctctgccacgacctctacctcggcctctgggaccacctctaccgcctccacggccaccacctccaaaacctcctcggaatccaccacgtccaccggctggagctgcgtccgccattgtttagttccttc

SEQ ID NO: 764 - DNA, 664 bp, Diabrotica virgifera
ggcagacgctgatgatctattagattatgaagatgaggaacagacagaacaaaccgcaactgaaacggcaactacagaggtacagaaaaagggtgtcaagggcacatatgtatcaatacacagttctgggtttagagattttctgttaaaaccagcaattctcagagctatagtggactgcgggttcgaacatccttcagaagttcaacatgaatgtattcctcaagctgtcattggcatggatattctgtgccaagctaaatccggtatgggaaaaacggctgtttttgtattagctacactccaagtaatagatcctacagaaaatgttgtatatgttctcgtcatgtgccataccagagagttagccttccagataagcaaagagtacgaacgtttcagtaaatatatgcccaatattaaagtaggggtcttctttggtggcttgcctatccagaaagatgaggaaacgttaaaaaataattgcccgcatatcgttgtgggtactccaggaagaattttagcattggtcagatcgaaaaaacttaatctcaaacatctaaagcattttattttggatgaatgtgataaaatgttggagttattagacatgagacgtgatgttcaagaaatatatcgtaacactccccacgaaaaacaagtc

SEQ ID NO: 765 - DNA, 434 bp, Diabrotica virgifera
caagagaggacgtggtggttccgcgggagcgaagtttaggatctcccttgctcttcctgtaggagcagtaattaattgtgcagataatacaggagcaaagaacttatatgttatcgctgtacaaggtattggtggacgacttaaccgtctgccagctgcaggatctggtgacatgattgtagccacagtcaaaaagggtaaaccagaactcaggaaaaaagtcatgcctgcagtagttatcaggcagcggaaaccatttagaaggaaggatggtgtcttcatttactttgaagataatgctggggttatagtcaataacaaaggtgaaatgaaaggatcagccatcactggtccagttgcaaaagaatgtgcagatttatggcccagaattgcatcaaatgcaagcagtattgcttgatgtgtatatgtttaag

SEQ ID NO: 766 - DNA, 1283 bp, Diabrotica virgifera
ccaccctcaggcgtaggtatgaatgcaggcgttaatttgagtggcatttgcattttcttgcttatacttagcctatagttccttaaaactgtcatgatacctacttttacttgaatgatgccaaacctcatacctaaacataacctagggccttctccaaaaggaacatatgtgtatggaataatgttctttctgttctcttctgaaaatcgttctggatcgaatacatctggattatcataatattcttcatcatagtgaatacctatggtaggtatgacgactcttgtgcctttttcaactactatgtttgtctcaggtatctggtaatcttgagaacattctctggtgagaaaaggaattggtggatatttccttaatgtttcatcgatgcattgacccatatatttaagatcgcagagggactcgtaggtgatttcgccgttgtgattgtttagtacttcttctatttcttctctaactctttcttggatgtcgggattggcagccatctcgtataaaacccatgacatagtggttgcgctggtttcgtagcctgctacgaaaaacacgaaactttgagccactatttcgtccattgtgatagctgtctcgtcgtttaattttcctcttgtttctggatcgttcttaatattgatcagtccttgtaagaaatcattacgatcaattttactattttccctatacgtaacagtatcaacaaactttcgtgaaaaattccttaatagtcttcggtatccaagtcaatctgatagcactagctaattttggaaagttgattgcaacagcaaatttgacgtcatccgaaagtgttctgtttacgattctattggccatctgcttgaacggattgtcatcttcgaaactgttgcagtctattccaaatgcgcatgaacctattacgctgatggtgaaactacccataaattgtttaagatcaacgggctcctctccattaatctttgtgcttaagcaattctccaacatttttccacatgaaatgacagtgtgaaacatcgattttaactttcccgatgaaaaatttggcgtaaatttacttctaaggctcttccattttgtcccaccaagtgcaaataagtgagcgcctataggttcatctttttcattgatatatattcctcgggcattaaagtaattaaaatccttggctaaaacccgctttataagatcattatctactggcatataaattggagatatagcggcataaagtccgatgtgtttgtgtccatctcgcttag

SEQ ID NO: 767 - DNA, 685 bp, Diabrotica virgifera
cagactacggctcacacgagagtaggttgtacaaacatgatttacaacaattttgcactaatttcaatagtaacatgaatctagaagtgcccccctttgaaagtcctgccaccaacttatctagatttacaaaagatgatactggaaaggctctaaaaattaattttgatcatggtaccacaaccttgggattcatgtatcagggaggagttgtacttgcagtagattccagagctactggaggccagtttattggttcacaaacaatgaagaaaattgtagaaatcaatgattttctgttaggtactctggctggaggcgcagcagattgtgtctattgggacagagttttggccaagcagtgtagaatgtatgaactcagaaatagagaacggatttcagtagcggctgcttctaaattaatggcaaatatggtttacaattataaaggaatgggattgtcaatgggtatgatgttagctggatgggacaaaaggggaccacaattgtattacgtggactcagaaggtctgagaacagcaggaaaagttttcagtgttggttccggttccatatatgcttttggtgtactagactctgggcacaaatgggatcttacggacgaagaagcatatgatttgggccgtagatcgatttatcacgctacccacagagatgcttactc

SEQ ID NO: 768 - DNA, 859 bp, Diabrotica virgifera
gcgtactaagggacccgacacagctttaaaactaccagcggttactcctcatacaagatgccggttgaaactattaaagttggaaagaataaaggattatttgcttatggaagaagagttcatcagaaaccaagaaaggctgaaaccacaagaagaaaaaaatgaggaggagagatcgaaggttgatgatcttagaggaactcccatgtctgttggtacattggaagaaatcattgatgacaaccatgcaattgtttccacatcagtaggcagtgaacattacgtgagcattttatcctttgttgacaaggatcaacttgaaccaggatgttcagtacttttgaaccataaggtgcacgccgttgtaggtgttttaggtgatgatactgacccaatggtaacagtaatgaagcttgaaaaagctcctcaagaaacctatgccgatattggtggtctagatacacagattcaagaaattaaagaatctgttgaattacctcttacccatcctgagtattatgaagaaatgggtatcaaaccacctaaaggtgttatcctttatggccctccaggtactggaaaaactcttctggcaaaagctgttgctaaccagacttctgcaacatttttgagggttgttggttcagaacttatacaaaaatatttgggtgatggacctaaactagtccgagaattatttagggtagctgaagagcatgctccttccattgtatttatagatgaaatcgacgctgttggtacgaagaggtacgattccaattctggcggtgaaagagaaattcagagaactatgttagagttattgaatcagttggatggattcgattcaaggggcgac

SEQ ID NO: 769 - DNA, 586 bp, Diabrotica virgifera
cgtcggttcattctaaaacctatgtaacgcctaggcgtccatatgagaaggcccgtttagatcaagaattgaaaatcatcggagcctttggtctccgaaacaaacgtgaagtgtggagagtaaaatacactctagccaaaatccgtaaggccgccagagaactgcttactctagaagagaaagaacccaaaaggttgtttgaaggtaatgcactcctacgtcgtttggttcgtattggagtactagacgagaacagaatgaagctcgattacgtattgggtctcaagattgaagatttcttggaaagacgtctgcaaacacaagtcttcaaatctggtctagctaagtcaatccatcatgctagggtattgatcagacaacgacacattcgggtccgcaaacaagttgtgaacattccctccttcatcgtccgtttggattcacaaaaacacatcgacttctctctgaaatcacctttgggaggcggtcgtccaggacgtgttaagaggaagaacctcaccaagaagagcggtggtggaggtgcagctgaagaagaggaagactaagctgtatgtcgtgctagttg

SEQ ID NO: 770 - DNA, 563 bp, Diabrotica virgifera
ggatagacttcttcgactagaggtggaatgccaggtttaactcaggcaccgccgccttctgatgctcctgttgtggatactgccgaacaagtatacatatcctccttagcactattaaaaatgttgaagcacggccgagctggagtacccatggaagtaatgggtcttatgttaggagaattcgtagatgactataccgttcgtgtaatcgatgtatttgctatgcctcagactggtaccggtgtcagtgtagaagctgttgatccagtgtttcaagcaaaaatgcttgacatgttaagacagactggtaggccagaaatggttgtggggtggtatcattcccatccaggtttcggatgttggttgtctggagtggatatcaacacccagcaaagttttgaggctctctcggaaagagctgtagcagtagtagttgatccaatccagtcagtgaaaggcaaagtcgttattgatgcctttaggttaataaatccgaatatgatggtattgggccaagaacctcgccaaactacatccaacttaggacatctacagaaaccatc

SEQ ID NO: 771 - DNA, 1216 bp, Diabrotica virgifera
cctgatttagaattagcacattgtaagtttctgttaactttaccagaatatcgcagtgataaaaacgtccactccaaaataacagaagctataaagaaagatgatatggccccatggtatgaacttatttgtaaagatgctggttggaaacttgatgctaatctactgagtgcattaaaagctaagaacgctgagaagatcaagcttttggatgaagccatagaagatgccgagaaaaatttaggtgaaatggaagttcgagaagcctacttaagaaaagcagaatactacagccgaattggtgataaagacaacgcagttagtactttcagacaaacatatgataaaactgtatcacttggtcatcgtttagatattatttttcacttgataagaattggtttgttcttcatggaccatgatctcatcacaagaaatattgaaaaagctaaaacccttattgaagaaggaggtgattgggatagaagaaatcgtttaaaagtgtatcaaggtgcatattgtatgtcagtacgagacttcaaatcagctgctaacttgtttttggacacagtaagcacttttacatcatacgaactaatggactataaagcatttgtcaggtatactgtatacacctctattattagtttgccaaggaaccaattaagagataaagtggtcaaaggttccgaaatattggaagtactgcattcagaaccatttgtaaaagattaccttttttctttatataattgtcagtatgctgaatttttcacaaatcttgcagaagttgaaacagttctcagaaaagattatttcttgaatcctcactatcgtttctatgtaagagagatgaagatacttgcttatacacaattattggagtcatataggtctcttactttacaatacatggcagaagcctttggagttactgttgaatacattgataaagaactgtccacatttatagcagcaggaagattgcattgtaaaattgatcgagttgggggaattgttgaaactaatagaccagatttaaagaatgcccaatttaattctgtggtaaaacaaggagatttactgctgaatagagtccaaaaattatctagggtgatcaatatctaaaaaatgtattcttaagtttataagtaaattataaaacatactgataatttgacttgattgtactaattttctatgtttatctagtgct

SEQ ID NO: 772 - DNA, 617 bp, Diabrotica virgifera
cctctggaaagttggttcagattgaatatgcattagccgctgtagcggcgggtgctccatcagtaggaattaaagcatcaaatggtgtggttattgcaacagagaacaagcacaaatcaattctgtatgatgaacacagtgtccataaagtagaaatgatcacaaaacacattggtatggtttattctggtatgggtcctgactatcgccttcttgtgagacaagcacgcaagatggctcagcagtattacctagtataccatgaacccattcctacagtacagttggtgcaaagagtagcgactgtaatgcaagaatacacccaatcaggaggagttagaccatttggagtgtcgctactgatttgtggttgggataacaacagaccttacttgttccaatgcgatccttctggagcttactttgcttggaaagctactgcaatgggaaagaattatgtcaatggaaaaacgttcttagaaaaaaggtacagtgaagagctagaactcgacgatgctgtgcacactgctatccttaccctgaaagaaagttttgaaggccagatgacagctgacaacatagaagttggtatttgcgatgctaatggattcagaagg

SEQ ID NO: 773 - DNA, 736 bp, Diabrotica virgifera
gtctcagcctgaagcaactttccttaaagaattaacatataggagtaccaatacaaaagaaccaggagtagtaactgctccctcgtctaaccttaatacagcctttcgtctaattaaagaagttcaaaggaaatttaagacacgagaagctgaagaaaaagaaaaagaggatttggttaaacagggcacattagtactttcacagaataaaggaaatcctaaattaaaagatctgtatattaggccaaatattgtttcaaaacgtatgacaggatcattagaagctcacactaatggttttaggtatacttctgtgaggggtgataaagtagacattctttacaacaacatcaagaatgccttctttcaaccgtgtgatggagaaatgataattctgttacattttcacctaaaacatgctatcatgttcggaaaaaagaaacatgttgacgttcaattctgtacggaagtcggagaaattaccacagatttgggcaaacatcaacacatgcacgatcgagatgatctggctgctgagcagtcggaaagagagctcagacaaaaattgaaaactgcattcaaaagtttttgtgaaaaggttgaatctatgacaaaacaagaaattgaatttgatacaccattccgggagttgggatttccaggagcccccttccgctctacagtccttctccagcctacatctggttgtttggttaacctgactgaatgggcctcc

SEQ ID NO: 774 - DNA, 718 bp, Diabrotica virgifera
gactggtacgatgtgaaagctccatcaatgtttgccacccgccaggtcggcaggactttggttaaccgtacccaaggaaccaaaattgcctctgaaggtttgaaattcagagtttttgaagtgtctttagccgatttacaaaatgataatgacgccgaaaggtctttcagaaagttccgtttgatagctgaagatgttcaaggtagaaatgttttaacaaatttccacggtatggatttaaccactgacaagctgaggtccatggttaagaaatggcaaaccttaattgaagcatctgctgatgtcaagacatcagatggatatttacttagggtgttctgcataggctttaccaacaaagaccaactttctcaaaggaaaacatgctatgcacaacatacacaagttagagctatccgtaaaaagatggtagacattattaccagagacatccagggctcagacatcaaagaagtagtgaataaactccttcctgacagcatagccaaggatattgaaaaggcctgccagggtatctaccccctacatgatgtgtacatccgtaaagttaaagtattgaaaaagcctcgttttgaactctccaaattgttggaattgcatggtgatggaggcaaaggtggtgctggtgactccactggtgaagctggttctaaagtcgacaggcctgagggatacgaaccaccagtacaagaatccg

SEQ ID NO: 775 - DNA, 598 bp, Diabrotica virgifera
gttgagaggtgcatttgcaggatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccacaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatg

SEQ ID NO: 776 - DNA, 683 bp, Diabrotica virgifera
gagatagaagagccctacagccagatgccatgtattatccagacttaatgcctccccctagttatcctgataatcctattaattgtgttactactagatttgtaaaaactgctacaaataaaatgaggtgcccaattttctgtatggcctggacacccgagggcagaagactggtaactggtgctagttcaggagaattcacattatggaatggattaacatttaatttcgaaactatcttacaggcacatgacagtccagtcaggacgatggtatggagtcacaatgacagctggatgataacaggtgaccattctggttatgtcaaatattggcagtcgaacatgaacaatgtgaagatgttccaagcgcacaaagaagcacttcgaggcataaggtatctacaacttctctccgtaattataaaacttgtacacttacttatattttactttatcaataaaagatccctccttctccctacattagtgcaaaataaagaaatcaattttaaataacgccatcaatattttccaaacaatacattgcatttcaaattgtctagttggaaacattgtacttaactgactctattagagtttctgaatagaccatacaaaactaattcccttaaagtaagatggtgaatggacattgattccgaaggcaacagtccccaaaca

SEQ ID NO: 777 - DNA, 321 bp, Diabrotica virgifera
ccacgcgtccgttttatagtaaagccagcatggcaccaaggtacgagatcgcagtcggcctccaaaggggtcacaaaaccaccaaaatctcagacaaatccaaactgaataaagttcgtcccgctaggttgaaggggatccaaaccaaacacaccaaatttgtcagagacatcatccgtgaagtcgtaggacatgctccatatgaaaagagagccatggaattgttaaaggtgtcaaaggataagagggccctgaaattcctgaagcgtcgtcttggcacacacatcagagccaagaggaagcgtgaagaactatccaaca

SEQ ID NO: 778 - DNA, 311 bp, Diabrotica virgifera
ccagccccacaagtacaatctggtgggcccatggacgtaaatcaagcactccaagaggtcttgaaaacagcccttattcacgatggagtcgttcatggtttgcatgaggctgctaaagctttggataaaagacaagccgtactttgtgtgctcgctgaaaactgtgacgagcctatgtataagaaactagtctcagctttatgctcagaacatcaaattcctcttattaaggtagacaataacaaaaaattaggcgagtggtcagggttatgcaaaattgataacactggtaaagcacgaaaggtcgttgg

SEQ ID NO: 779 - DNA, 501 bp, Diabrotica virgifera
gtgccagtgcttaattttcctcgatgatccattgtctgtggctgaaattttagacaggcttgtaactggcaaggaggatactgaacttatggcatatcaaattgcttttgatctctatgagtcagctactcaacagtttttggaaagagtattagttgcattaagagccacagcaccagttccatctttgctggaagaaaaagcaaagccaaagccttctggtgaaggagagggtgctatgtcaaccgagactggagaaccatctacagaaacaaaagaagaaaaattaaaagaagaaaaatctctggatagtttgtctgatcaggataaggaacatcagaaaagaattgagaaacttcatactatactctcaggggaggtctctatagaactgcaccttcaattcctcatcaggtcaaatcatgctgatctactgattcttaaacaaacaaaagagactgtcagagttagtatttgccacactgctactgtaatcgcaaa

SEQ ID NO: 780 - DNA, 370 bp, Diabrotica virgifera
ttgccgttcaaaatgccatgcagcatttaaaaagaaaaagaatccacgtaaagtaaaatggaccaaggcgtacaggaaaacagtaggcaaagagttaacaatagatccatcatttgaatttgaaaaacgtagaaacataccacttaaatataacagagaaacctggtcaaaggctgtagaagcaatgaaaacggtagagaaaataaaacagaaaaggcaaggagcctacatcatgcaaagattacgtaaaggtagagaaatcgaacaagaacgagacatcaaagaggtacaaagggatctgtctcttatcagatccccagctgttggacttaaagaaagaaaacaagaagaatctatggcgcaagatcac

SEQ ID NO: 781 - DNA, 673 bp, Diabrotica virgifera
ttggagacaagttcgcgtctaggcacggacaaaagggaacgtgcggtatacaataccgtcaagaggatatgatttttagtgctgaaggtattacgccagacattatcattaatcctcacgctatcccctcccgtatgacgattggtcacttgatcgagtgcatccaaggtaaggtatcatccaataaaggagaaatcggtgatgctacacctttcaacgatgccgtcaacgtacagaaaatctccactttgttacaagaatatggttatcaactcagaggcaacgaagtaatgtacaacggccatactggacgtaagataaatgctcagattttcttaggacctacctattatcaaagattgaagcacatggtggacgataagattcattcaagagctagaggaccgttgcagattctcgtcagacagcctatggagggtcgtgcaagagacggcggtctacgtttcggtgagatggaacgagattgtcaaatttcacacggtgcggcacaattcttaagagagaggctgtttgaagtttccgatccttatagaatccatatttgcaacttctgtggtttgatagctatcgccaatttgcgtaacaacacctttgaatgtaagggttgcaaaaataagacgcagatatcgcaagttagactgccttatgctgc

SEQ ID NO: 782 - DNA, 411 bp, Diabrotica virgifera
tagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaac

SEQ ID NO: 783 - DNA, 553 bp, Diabrotica virgifera
agagaccattggcataaacgaaggtccacaggaggcaagaggaagcctctccgtaagaagaggaagttcgaattaggacgtccagccgcaaataccaaacttggagcacgtagaattcactatgtccgtacacgaggaggtaacttgaagtaccgtgcattgaggattgaaaaaggaaatttcgcatggggcagcgaaggtactgctcgtaaaacacgtattattgatgtcgtttacaatgccagtaataacgaattggtacgtaccaaaacattggtaaagaatgccatcgttgttattgacgcaacccctttcagacaatggtacgaaagccactatattttacctttaggacgcaagaagggggcaaaattgacagcggaagatgaagaaatgttcaataagaaacgtagcaaaaaagtacagaaaaaatatgaaactaggcaaaaaacagctaaagtagaacctgcattagaagaacaattctcaactggaaggttattagcttgcttagcgtcaaggccaggacaatgtggtagagctgatggttacg

SEQ ID NO: 784 - DNA, 902 bp, Diabrotica virgifera
gacccatgaatgcagctttgtcagcagctgtctggaatctaccatgaccgaatttagatgaggtatcaatgaatttaagattgatcttctccaaagcaatacgtttagtgtggactaacaatgacttcctcaatgtaataacacgtttctttggtcccatacaacgtcctttaatcataacaaagtcattgttaacttcaccataatgaggaaaaccacccattggggtaatagttttttcactaagatcgtaggcagtggctgcattatttttgacaaccttgccatctttagtgtggattccagcaccaattctgtagatctttttgttcatctcagttctgtgatggtaacccttttgaccagcacgagcaactgtgaatgatactcttgaaggatgccatgctccaatacaggcaactttacgaagacctttgtgtgtcttacggggcaatttctttgtgtgccaacgagaagtaacacctttgtatccatgacccttagtaacaccaatgcaatcaatcatttcatcttgagcaaaaacgttggcaataggaataggcttttcaaggtgttctttagcccaagctactttgtcagctacactaccaccattcaattgaatttccataatgtgggctttcttttgacgttgtttcaacaatttcatctgagtatgagcaataactctgacaactttacagtatttaacaatcttctttaagtccttttcgatggacttctttcctaaatcatcactccatttcttggaagctttggtaaatgccttcttcttgctcttgtaccagttcttgtagaagcgcctgcggcaatcttcagagagatgctcagcccaaactgtggctaaagccctaagaccatgtggagtttcgatgtaaccg

SEQ ID NO: 785 - DNA, 1026 bp, Diabrotica virgifera
agaacaacgggagcttcggttcgcactcaaaatgttatggcagcctctactatcgcaaatgttgtaaagagttcattgggaccagttggtctagataaaatgttggttgatgacattggagatgtgacagtaactaatgacggagctaccattttacgtcttttagaagttgaacatcctgccgccagagtattagtagaattggctcagttacaggatgaagaagtaggagatggtacaacttcagttgttatcatagctgcagaattactaaagaatgctgatgaactcgtgaaacaaaagatacatccaacttcaattataagtggatacagattagcatgcaaagaggcttgtaggtacattcaggatcatttgactattccagtcgaagaattgggaaaggagtgcatcataaatgttgccaaaacctcgatgagctcaaaaattattggagctgatgctgatcttttttcacaaatcgttgtcgatgccgccaatgctgttaaagtgacagattcaagaggaaatagcatgtatcccataaaggctgtcaatgtcttgaaagcacatggtaaaagcgccagagagagcttccttgtaccaggttatgcattaaactgcaccgttgccagccaagcgatgcccaaaaaaattgttaacgccaaaatcgcatgtttagatttttcattgcagaaggctaaaatgaagatgggtgttcaggttttgattactgatccaaatcaactggaagcaatccgcacaagagagctcgacatcaccaaagaacgcatccagaaaatcctctctaccggtgttaatgttattcttgcgagtggtggtatcgatgatctttgcctaaaatacttcgttgaaaatggagcgatgggtgtaagaagagtaaagaaagctgacttaaaacgcattgccaaagcaactggtgccactttcctaacttctcttagtaacatggagggagatgaaagttttgattctagcatggtaggagaggcagcggaagttgtt

SEQ ID NO: 786 - DNA, 469 bp, Diabrotica virgifera
cacattcgcaaactctgccttaacatttgtgtaggagaatctggtgacaggcttactagagctgctaaggtattggaacaacttacaggacaacaacctgtattctcaaaagccagatacactgtcaggtcttttggtatccgtcgtaatgaaaaaattgctgtacactgtacagtaaggggagccaaagctgaagaaattttagaaagaggcttaaaagttagagaatatgaattgagacgtgataacttctctgcatctggaaactttggatttggtattcaggaacacatcgatcttggtatcaaatatgatccaagtataggtatttacggtcttgacttttacgtagtattaggaagacccggattcaacgtagcccacaggaggtcaaagactggtaaagttggattctcacacagattgacaaaagaggatgccatgaagtggttccaacagaaatacgacg

SEQ ID NO: 787 - DNA, 1159 bp, Diabrotica virgifera
tatgagcgcccatggacagtatgtatacgaatcaagtatgaatgtaggctttcgcagccgttttgtaatggtacattgttttctgagcgtataggtcgtggtctggaattatctattgtcatcttcaactgtagtagacattatcaaatttggaatttcgtgtgaatttgtttgttgccgtaccaaacaatccggaaatttctatactttcagttggtgtaaagggttatcctaactatctttatctttgtgctttgtacattttactaacatagattaatcaataaataaaattaatcaataatacttattaatttaatgatataattaaaacttttcatggaataaactttcaagtttgtgaaagcataaatttggaaataatattacaaaaaagcacatcatattatactcctttaggataaattagtatattgccatcatttactttttacacgtgtttattacataacgggcccacattgttttaaatgaaaatttctacaaatttgtctctacatttaataatcatctagatcaaattcttcgccgttatccatatcgtctagttgtaaactttggaagtctactttgtaccggagcaaacctccaattccaccaaaccctcgaacaaattgggagccctcttgagatttgtctgtaataatttctaaagtggcaccgaagttcttgtaattattcgccaaccattcaagaagaggttgacactcgaccaattccaattctacaccagtctctttatccgaaaaatgtgatttatctttttcttgttcaggagttaaatgcagtatagtttccgaacctgtagcatggtttttcaatacatatcgctgaatatctaaattctcccaacagattagtgtttctacagcacctaattccaagcccctaagagtatcttcaactccaaaacagtatttccccgtatcttggctaatttcatcgaaatatctgcctatcagtttcttttcttgaataaactttacattttgaagtgattcagctgctaattcgatggcttgattaaatccattctcaccaccatacgagacatctactagtttgattactttagcttgtaaccctggatcaaacatatcagattgactaagttcagtcttaaaatcggcactacccg

SEQ ID NO: 788 - DNA, 1261 bp, Diabrotica virgifera
cctgaagaaactcaaagcgcagatgtcgagaccttcgccttccaggctgaaatcgctcagctgatgagtttgatcatcaacacattctactctaataaagaaatcttccttagagagttgatctcaaactcctcagatgccttggataagatccgttaccaatcactcacaaatccatcctgtctcgactctggaaaagatttgcacattaaaattgttccaaacaagagtgaaggaaccttaaccatcattgatactggtattggtatgacgaaagcagatttagttaacaaccttggtacaatcgcaaaatcaggaacaaaggcattcatggaggccctccaagctggagctgatattagtatgattggtcaatttggtgtaggtttctactcagcctacttagttgctgatcgagtagtggttgtatcaaaaaataacgatgatgaacagtacatttgggaatcatctgcaggaggtagcttcacaataagaccagatgttggagaaccattgggacgtggtacaaaaattgttctgtacatcaaagaggatcaaactgaatttttagaagagaataaaattaaggagattgtaaagaaacactcccagttcattggttaccccattaaattgcttgtagaaaaagaaagggaaaaggaactaagtgatgatgaagcagaagaagaaaagaaggaagaagaggaagacaaagataaacctaaaattgaagatgtaggagaggatgaagatgaagataaaaaagatgagaaaaagaaaaagaaaaaaactattaaagaaaagtacactgaagatgaggaactaaacaaaaccaaaccaatctggacaagaaatgctgatgatataacccaagaagaatatggtgaattttacaaatcattgacaaatgattgggaagaccatttagcagtaaaacattttagtgttgagggtcaacttgagtttagagctttattgtttgttcctcgtcgtgtaccttttgatttgtttgaaaacaagaagaagaagaacaacatcaaattatatgtacgcagagttttcattatggacaactgtgaagaccttatcccagaatatcttaactttattaagggagtagtagactctgaagatttacctctaaacatttcaagagaaatgttgcaacaaaataagattcttaaggtcatccgcaaaaatttagttaaaaaatgtctggaactttttgaagagcttactgaggacaaagatggatggaaga

SEQ ID NO: 789 - DNA, 905 bp, Diabrotica virgifera
gtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgacacaaataatgtttgaaactttcaacaccccagccatgtatgttgccatccaggctgtactctccttgtatgcatctggtcgtacaactggtattgtgttggattctggtgatggtgtatcccacactgtcccaatctatgaaggttatgctcttcctcatgcaatccttcgtttggacttagctggtagagacttgactgattacctcatgaaaattttgactgaacgtggctactctttcaccaccacagcagaaagagaaattgttagagatattaaagaaaaactctgctatgtagctttggacttcgaacaagaaatggcaacagctgctagttccagttcccttgaaaagagttatgaacttcctgatggacaagtcatcaccattggtaatgaaagattccgttgcccagaagctctcttccaaccatccttcttgggtatggaagctgctggtattcatgaaacaacctacaattccatcatgaagtgtgatgttgatatccgtaaggacctatatgccaacactgtactctctggag

SEQ ID NO: 790 - DNA, 873 bp, Diabrotica virgifera
cacagacacaaggaaagatgaacaggaacgttgtattaccatcaaatcaactgccatatctatgttcttcgagttagatgataaagatcttgtgttcatcaccaacgctgaccaacgtgagaaagatgtgaaaggtttcttgattaaccttattgactctcctggacacgttgatttctcatcagaagtaacagctgcccttcgtgtcactgatggtgcccttgtagtagtagattgtgtatctggtgtatgtgtacagactgaaactgtactccgtcaagctattgcagaacgtattaagccaattttattcatgaacaagatggaccgtgccctcttagaattacagttggaatctgaagaactttaccagactttccaacgtattgttgaaaacgtcaacgtcattattgccacctacaacgatgattcaggtccaatgggtgaagtcagagttgaccccagcaaaggttcagttggttttggatcaggtctccacggatgggctttcactctcaaacaattctctgaaatgtatgccgagaaattcaagattgatgtagttaaactaatgaaccgtttgtggggtgagaacttcttcaaccccaaaaccaagaaatggtccaaacaaaaggatgatgataacaaacgttcattctgtatgtacatcttagatccaatctacaagatttttgactccatcatgaactacaagaaagaagaatatgaagcactccttccaaaattgggtattgccttaaaacatgaagataaagacaaagatggtaaacaattattgaaagtagttatgcgtacctggttgccagctggagaagctttacttcagatgatagccattcacttaccatcacc

SEQ ID NO: 791 - DNA, 877 bp, Diabrotica virgifera
caaatcaactgctggagacactcacttgggaggtgaagacttcgacaacagaatggtcaatcactttgttggagaattcaagaggaaatacaagaaggaccttaccacaaacaaacgtgccctccgtcgtttgagaacaagctgtgaaagagctaagcgtaccctttcctcatcaacccaagccagcattgaaatcgattctctatttgagggtattgacttctacacctcaatcaccagggctagatttgaagaactgaacgctgatttgttcagatctaccatggaacctgtagaaaaggccatcagggatgccaagatggacaaatctcaagttcacgatattgtgttggttggtggatctacccgtattccaaaggtacaaaaactgttgcaagatttcttcaatggtaaagaattgaacaagtcgatcaaccccgatgaagctgttgcttatggtgcagccgtccaagccgccatcttgcacggagataagtctgaggaagtacaggacttgctcttgctcgatgtcactccactttcattgggtattgaaactgccggaggtgttatgactgccctcatcaaacgtaacactaccattcccaccaagcaaacccagaccttcactacttactctgacaaccaacccggagtacttattcaggtatatgaaggtgaacgtgccatgaccaaggacaacaacctcttgggaaaattcgaacttaccggcattcctcctgcgccccgtgttgtccctcagattgaagtaaccttcgacattgatgccaacggtatcttgaacgtcacagctattgaaaaatccaccaacaaagaaaacaagatcaccatcaccaatgataaaggtcgtctcagc

SEQ ID NO: 792 - DNA, 375 bp, Diabrotica virgifera
cgtggattgagaaccgctaggaaacatgtgaatcaccgtcgtgaacaaagatgggctgataaagattacaaaaaggcacatttaggaactagatggaaggctaatccttttggaggtgcttctcatgctaaaggaattgtattggaaaaagtgggagttgaagcaaaacaacctaactctgctattcgcaagtgcgttagggtacagttaattaaaaatggtaaaaaaatcacagccttcgtacctagagatggttgcttaaaccatatagaagaaaacgatgaagttctagttgcaggttttggacgtaaaggtcatgctgtaggagatattcccggagttagatttaaggttgttaaggtcgctaatgtgtcc

SEQ ID NO: 793 - DNA, 547 bp, Diabrotica virgifera
cgcaactgggtcaccagcttggattctcatcaacatattttcctttaatttatatcttgctaacaattcttgtttttcttctggtgtcattaccacatgttctggtaccaattcatgttcagtaatattgatcaacaactcggattccaaaaattgttctaatatgtattttggagccatatcaactagtgactgtttggcagatggtgtcatacctgcttgaacaacaataatagctctatgaatattttcttcctgcatacgggaacaataggttttaatggtttttattccaatttttggttcgtctgggaaaaatacaaacaactggtctgtaggatcatcattgtgagctaccaacacgatcaaatcacttcttgacggtcttttctcgctaggtttgtctccaaactgttccttaaattgttctaatgtttgatccaattcatcttgagttactaggtagcctctatcgtgacataactgcatgacagtttttctgattctccatagtttgtacgtttcagcttcgtcatccattatttag

SEQ ID NO: 794 - DNA, 334 bp, Diabrotica virgifera
gtgtcagattcaccatgattatcccagtaaggtgttttacctgtggaaaggttattggaaacaaatgggaggcttatttgggtcttctacaagctgaatatacggaaggtgacgctttagatgcccttggcttgaaacgttactgctgcagaaggatgcttttgggacatgtggacctcatcgaaaagttgttgaattatgctcctttagaaaagtgaaactgtagctttaaggtttatgtatataatttaaaaataatgaccttatccatagttaatttgtatattttagttctacaaaataatgcattgactttcataggcttataatttgg

SEQ ID NO: 795 - DNA, 630 bp, Diabrotica virgifera
aagtggtgcattttgtaaccatcgtttttgtgtattgtttaaagttttcagttgcaaagtgtagatctcataaatataacactctattttgaaaatggcaaacacaaacacagacttaacggaagaagacgcagcagacctacagtttccaaaagaatttgaaaatgcagaaactttattaatatcggaggttcacatgttattagaacatagaaaggatcaaaatgaatctgcgaaggacgagcaagaattttcggatgtatttatgaaaacattaacgtatacagatcgatttaggaaatttaaaaacaaagaaaccatatcagctgtaagaaatttactaatgcagaccaaaaagcttcataaatttgagttggctgctatcgcaaacttgtgtccagaaaccacagaggaggcgaaatctctaatcccttccctggaagggcgatttgaagacgaggaacttcaggcaatcctggatgatattcaaactaaaagaagtatccagtactagagaaaaaagtcaatagtcatatttaatttcagattttttctttttatattttggaacaatttaattatttatattatttgaaaatgcaacaactttttcacgatgtaatgttagtg

SEQ ID NO: 796 - DNA, 1152 bp, Diabrotica virgifera
acgccaaacctcctaagcctaataaaatctttcctaagacaactacctacaatacgatcatcattgatacccaagttgacgagaacacaacaataaggcgtratatcaaggaatctcaagcatctctctcaaatgagcaagcattttgatgattctccctccaggcgtccaatttaaatgcaacatataaaaacaattgtgccgtcaaaaacacgctataaattgccaaaactatataagagaatcaacaaaatcctcgaagttgtatgtttatccctatttactgtaaaaaagatataaaaaatccaaaattaattatcttctgtgtttgttagttgatgagacccttggccttgaagagatcacgcatgagccccttaaggtacttaatttcgcgatttagatcagctatttgacttcccaaatcaacgttcttgtccagaagacccttttcttcactaagaattacctcaatctcggccttcttcttttggcgatacctggtagcagcgttcttgttttgctccttcttgcgaaccttcttgtcctcggtaccgcttttagagtaaggtctggtccttttgcgggatgacttaacaggaagttcgtcgttgtactgttcaattggctctggcatccattccggatcagaagagcagtcgccaaagttgctgctactgctactactgctcggggatccaggactgctgcttccgctactgctccattgcatgtcttccacacgagttctgactagctcgtccacgacggccagctccatagcaatatcgggctgaggagtattaacgggcaaggaatagttgatctcgtagttctctggcagaaattgcttctccggttggacgtaaacacgcttggtttccactggatactgtagaagtggctcgagattggtgagcattggttggctcgggggagactgaggtggagtgagcgtgccatgggagaattccacgacttcgtacacgttctggaattccttgaggaaatattgggtgtcattggagttgacaaactcattcttcaagttttgaacaggtactggaatggcacgcggaggttccacttcgtccaggattggtagtattttttcatcgagaaggaagggttcgtaacagatagacatcattc

SEQ ID NO: 797 - DNA, 988 bp, Diabrotica virgifera
ctcttggattgatgcgtgagtttagatcttcgattctaacatgtcgacgttcagcttgtagtaaacgtatgggtaatactctgattggccgaatccgaggcctggaatgtcaacgctatcaacgttaggtcctgaaagggcagcactactatcgaggtggccgtaaagttggttcaagacatctcttaaacgttttaattgtttcttattggggtggattaaaatagcttggaaattgacggggaggccatatcttaaaacagattcaacaaataccctcaacgctttaacgtgaatccaggcgcagaaacactcgctgaagttgactttaagccatctaactaatggaccaaattgcttctttttatcggtgacgagtttggttatctcgttctttccagctgccagttcctcttcgttatatatgaaatcacgaacgatgaacttcttttctctagcgtgtaacttgaattcttcgacgacctttttgaatagggatacagtatatagaccgtgttcgttatcctgtttaatcagttgtgaagaacgagggactatcatgtcggtaatcttttcgtatgtcgcattccattcgttgaattgggcttttggaactataaccaacaatgtctgcaaatattcagaatccaaaataaaatgttcctttttcaccaaatctgccaagtttcttgttagtaaacttcctgtctgtttcttctccaaattctgaagacttcctttcaagttattgtacgcagacgatttggtcttcagatcagcgtcaatttggccaacttgtttgctgattatatcggcgatgttacggagcgattgcttgatgggatatttggcgatgtcccaagtaaatcgggttaaataagtgggcaaatcgctgttattggcctgcaggttttctgaccacttgtctctctgttcttcaagtacttctccaaggtactgagctacctttctggtgacctgctccacg

SEQ ID NO: 798 - DNA, 208 bp, Diabrotica virgifera
gagtgcctggagagctgctggattaaactacattaactattccaacattgctgccaaacttctgaggcaggcacttaaacctgaacttagaacagaagcaatgagaagaaatgaaacccatattaaagtaaccaaatggcaagatggaaagccaataagggagtccacattttaaatccataatttaagtccaagtctatgtagtgtt

SEQ ID NO: 799 - DNA, 1326 bp, Diabrotica virgifera
ctgtatctggtgtcaacggtccactagtaatcctcgaagatgtcaaatttcctaagttcaacgaaattgtccaactcagattatctgacggaagtttaagatcaggtcaagtacttgaagtcagcggttccaaggctgtagtacaagtattcgaaggtacatcaggtatcgatgccaaacacactgtctgtgagttcacaggagatattctcagaactccagtctctgaggatatgttgggaagagtattcaacggctctggaaaacctattgacaaaggtcccccaattctggctgaagactacctagatattcaaggacaacccatcaacccatggtcccgtatctacccagaggaaatgatccaaactggtatcactgccatcgatgtgatgaactcgattgcccgtggtcagaagattcccattttctcagctgctggtctgccacataacgatattgctgcccaaatttgtaggcaagccggtcttgtcaaaatcccaggcaaatcagttttggatgaccacgaagacaactttgccatcgtgttcgctgctatgggtgttaacatggagactgctagattcttcaaacaagatttcgaagaaaatggttctatggaaaacgtatgtttgttcttgaacttggctaacgatccaaccatcgaaagaatcatcaccccacgtcttgctctaacagccgctgaattcttggcttaccagtgcgaaaaacacgtgttagtcattttaactgacatgtcttcatacgctgaagctttgcgtgaggtatctgccgccagagaggaagtacccggtcgtcgtggtttccccggttacatgtacaccgatttggccaccatctacgaacgtgccggtcgtgtcgaaggccgtaacggttccatcactcaaatccccatcttgactatgcctaacgacgatattactcaccctattcccgatttgacaggttatattaccgaaggacagatctacgtcgaccgtcaattgcacaacaggcagatctacccaccaattaacgtactgccatctctctcacgtttgatgaagtctgctatcggcgaaggtatgaccaggaaggaccactctgacgtttctaaccaattgtatgcttgttatgctatcggtaaggacgtccaggccatgaaagccgtagtaggtgaagaagctctaacacccgacgatcttctctacctcgagttcctaacgaaattcgaaaagaacttcatcacccaaggaaactacgaaaaccgcaccgtcttcgagtctttggacatcggctggcaactactccgtatcttccctaagg

SEQ ID NO: 800 - DNA, 1034 bp, Diabrotica virgifera
ccgggatttagtaggggcggtccttccggaaagcgtttcttcacttccttaatagctttgtgcattccttttcgactatctttcgaccttagatcgttgggacagaacagccgcacggacgataaatgagttatcagcgtcgaatctacagtcactacctcgatttcgcctttctggtcttccaaacacggtttcggtatcatcgtttcatcgctattttctggtaatacgtgtaacaaaatatccactttgactttagtttgggttttgctttgtccttgtttatttttgcgccccggaataatctcttggacctttttgaagttaaccacagcgccccaatcgtattcatcttcagtcgattttatctttaaaagtctaccaggttgaagaaacggcaacaaatattgcgagcttgtgagatatgtcctaaacttgacacccaacaggtctaactctgttctaattacgtgataagactgtattcgctcttcatctttgatttcaagcgaattgaaaagttctaatttttcgttataatcatcataatatccgggtattgcagcttgattctgaaactggaagaacgatcgctccaacatatactcaggattgatttcttcgacccttagcaagttcagtaccatattgtaagtcaaatggaaggcggagttgatggggtccggcaaacctttaactatgttcctaccggctgccggaggcactttctcgtccaccatcaatattacgatacctttatcgtccaggcctcttcttcctgcccttccagacatttggatgtattctccagaagtaatccatctgtactcactgccatcaaatttcctcattccagtaaacaacacagttcttgcaggcatatttaaacccatagcgaacgtttctgtggcaaatagcgcttttatgagcccctcgccgaataaaatctcgatggtttccttcaaaatcggcaacaaaccaccgtgatggatgcctattcctcttcttaacaacggcagaaggttctcgacttg

SEQ ID NO: 801 - DNA, 721 bp, Diabrotica virgifera
ggagaaaccatcccctatacaggaagcctctatccctatagcactgtctggaaaagatgtacttgctagagcaaaaaatggaacaggtaagactggtgcttacagtattcctgtgttagagcaaatcgaccctaaaaaagactgtattcaagcactaattatagtaccaacgagagaattagcattacaaacttcacaaatatgcatagaactagccaaatacctagaggtacgtgttatggtgacaacaggtggaacaaacttacgagatgacattatgcgtatataccaaaaagtgcaagttatcatagcaactccagggcgtatacttgacttaatggaaaaaggagtagcagttatggaccaatgtaaaattcttgtattagatgaagctgacaaattactgtctcaagattttaagggaatgcttgacactgtgattaaaaatttaccacaagagaggcaaattttactattttctgcaactttccctttgacagttgaacaatttatgagaaagcatttacgagatccgtacgagataaatctcatggaagaacttacattaaaaggtgttacacagtattatgcatttgtccaggaaagacagaaagtgcactgtttaaatactctattttccaagttacaaattaatcaaagtattattttttgcaattctacacaacgagtagaattgctggcgaagaaataacagaactgg

SEQ ID NO: 802 - DNA, 361 bp, Diabrotica virgifera
gctttagggcagtgtgtagaaactcctcgtctttacgatctttcagtacaaggcctttggcagtcacattagtaaatagatgcagtgatattttacaaaatagctcacaaagtaaacctggttctttgatcgatatacagacaagattctattcaccagaggtaataaaacctaaaccttctgaagaagaaatcaaacaaagggtgctgaaagtgtgttcttcatatgataaagtaactgcagaaaagctgactttgaactcccacttcatcaatgatcttggattagattccctagaccatgtcgaagtcatcatggcgatggaagatgaattcggctttgaaatcccagatgctgatgc

SEQ ID NO: 803 - DNA, 183 bp, Diabrotica virgifera
ggtctttctagcacaatttacaattccatttttaaaagaacctcaacaatggctttagctgttgttgtttctgcatttttcttcgagagaactttcgatttagcaacagacaccttttttgaaagatataatgaagggaaattatggaaacacatcaaggacaaatatgagcaggaataagtg

SEQ ID NO: 804 - DNA, 372 bp, Artificial Sequence; identical to SEQ ID NO: 716
  Description of Artificial Sequence: C4_Dv49_CG8055 concatemer; putative binding, carrier activity: CG8055 ortholog

SEQ ID NO: 805 - DNA, 372 bp, Artificial Sequence; identical to SEQ ID NO: 717
  Description of Artificial Sequence:  Synthetic Primer

SEQ ID NO: 806 - DNA, 490 bp, Artificial Sequence; identical to SEQ ID NO: 718
  Description of Artificial Sequence:  C6 concatemer of highly effective WCR targets, ~50% GC criterion, consisting of segments in order 5'-3' from Dv26, Dv49, Dv23, Dv20, Dv13, Dv22, Dv18

SEQ ID NO: 807 - DNA, 560 bp, Artificial Sequence; identical to SEQ ID NO: 719
  Description of Artificial Sequence:  Synthetic Primer

SEQ ID NO: 808 - DNA, 372 bp, Artificial Sequence; identical to SEQ ID NO: 720
  Description of Artificial Sequence:  C8 concatemer; putative sodium/potassium-exchanging ATPase: CG9261 ortholog

SEQ ID NO: 809 - DNA, 372 bp, Artificial Sequence; identical to SEQ ID NO: 721
  Description of Artificial Sequence:  C9 concatemer; putative sodium/potassium-exchanging ATPase: CG9261 ortholog

SEQ ID NO: 810 - DNA, 1000 bp, Artificial Sequence; identical to SEQ ID NO: 722
  Description of Artificial Sequence:  C10 concatemer of genes with putative same/different mode of action, ~50% GC criterion

SEQ ID NO: 811 - DNA, 478 bp, Artificial Sequence; identical to SEQ ID NO: 723
  Description of Artificial Sequence:  C12 concatemer of highly effective WCR targets, ~50% GC criterion, consisting of segments in order 5'-3' from Dv23-Dv13-Dv26-Dv18-Dv49-Dv22-Dv20.

SEQ ID NO: 812 - DNA, 869 bp, Artificial Sequence; identical to SEQ ID NO: 725
  Description of Artificial Sequence:  C14 concatemer of gene targets active in several different organisms, ~50% GC criterion

SEQ ID NO: 813 - DNA, 2694 bp, Artificial Sequence
  Description of Artificial Sequence:  xx
ggtcgacccacgcgtccggcttgagtaaaaactgaaatcatataaaagagataatttctattgtgaactaatttttcaaaagtttctacattaagtacatattcattactaaataatggccgaaaacaaaaatccagaggatttggccaccgcaattctccgtaagaaagatcgtccaaatagacttttggtagaagaagcagttaacgatgataactccgtggttgctttgtcacaagcaaaaatggatgaactacaacttttcagaggagacacagtcctactgaagggcaagcgaaggaaagaaactgtttgtatagtattatctgatgatacatgtagcgatgaaaaaattcgtatgaatagaaataatttaagagttaggctttcagatgtagtttctatccaagcttgccctgatgtaaagtatggcaagagaatacatgtacttcccatagatgatacagtggaaggactcacaggaaatctcttcgaagtatacctgaaaccctacttcctggaggcctatcgaccaatacacaaagatgacgtattcgttgtacgtggaggaatgagagctgttgaattcaaagtcgtcgagaccgatcccgctccgtactgtatcgtggctccagacaccgtcattcattgtgatggagatccaatcaagcgcgaagaggaagaggaagctcttaacgcagttggatacgacgacatcggaggttgtagaaaacagcttgctcaaatcaaagaaatggtagagttaccactgagacatcctagtcttttcaaggctattggagttaaaccaccaagaggtattttactttacggtccaccgggtactggtaaaacactcattgcacgtgcagtagctaacgaaactggagcgttcttcttcttgattaacggtcctgagattatgagcaaattggccggtgaatccgaaagcaatcttcgtaaagctttcgaggaagccgacaagaattccccagctattattttcattgatgaattggatgccatcgctcccaagagagagaaaacacacggagaggtggaacgccgtatagtatcccaacttctaactttgatggacggtatgaagaagagttcccacgttatcgttatggccgctactaacagaccaaactcaatcgatccagctttacgtagattcggaagattcgacagggaaatcgatatcggaatacctgatgcaactggcagacttgaagttttacgtattcacaccaagaacatgaaattggccgatgatgtcgacttggaacagatcgctgcggaaactcatggtcacgtaggtgccgatttagcttcactatgttcggaagcagcccttcaacaaatcagagaaaaaatggacctcatcgacctcgaagacgaccaaattgacgcagaagtcctaaactcactggcagttaccatggagaacttccgttacgccatgacgaagagcagcccaagtgctttacgtgagaccatagtagaagtaccaaacgtcacttgggacgatatcggtggcttggctaatgtcaagaaagagttgcaagaattggtgcaatatccagtcgaacatccagataagttccttaagttcggtatgcaaccgtccagaggagtgttgttctatgggccgcctggttgcggtaaaacgttattagctaaggctattgcgaatgaatgccaagccaactttatctcagttaaaggaccagagttgcttactatgtggtttggtgaatcagaagcaaatgtccgagatatcttcgacaaggctcgatctgcggcaccttgtgttctattctttgacgaattagattcaattgccaaatcgcgtggtggaaatgtaggtgatgccggtggtgcagccgacagagttattaatcaaattctaacagaaatggacggtatgggagccaaaaagaacgtgtttattatcggtgctacaaacagaccagatatcatcgatcctgcaatattgcgtccaggtcgtctcgatcagttgatctacatccctctgcccgacgagaaatctagggaagccatcttcaaagccaacttgaggaaatcgcctgtagctaaagacgtagatcttgtatacatcgctaaagtaacccatggattttctggtgccgatttgactgaaatctgccagagagcttgcaaacttgccatcaggcaaagcatcgaaacagaaattaggagagaaagagaaagggctttgaaccccaatgttgctatggatttggacgatgacgatccagtcccagaaatcaccagggcccmcttcgaagaggccatgcgtttcgccagacgttccgtttcagacaacgacatcagaaaatacgagatgttcgcccagaccttacagcaatctcgcggattcggtaccaacttccgtttcccgacagcagctggtggacctgctgctccaggaggtaccggaggagaccaggccaacttccaggacgatcctgaagacgatctgtatagttaaatgtttcaggtgggctcaataagcaccaactttcaattttatttttcatttttgtatttatttacagtaactcctcagtttgctaacaatattacattgttaacgcattcatatgttgtttaatataatagttttggaatataattacaagtttgtctaaaaaaaaaaaaaaaggg

SEQ ID NO: 814 - DNA, 622 bp, Artificial Sequence
  Description of Artificial Sequence:  xx
gtcacaagtagggctaaaatgaagcaaattgtaacaaaccaaacggtaaaaattcctgagggaattacagtaaccactaagtcaagggtagtaactgtaaaaggaccccgaggtaatctgaagagatccttcaaacatcttaccctggacattcgaatgatcaaccccaggttactgaaagtagagaaatggttcggtaccaagaaggaattagctgctgtcagaacagtatgctctcatgttgaaaacatgttaaagggtgttacaaaaggataccaatacaagatgagagcagcatatgctcactttcccattaactgtgtcaccactgaaggaaacacagttatcgaaattagaaatttcttgggagaaaaatacatcagaagagtaaagatggccccaggtgttacagtagtaaactccaccaaacaaaaggatgaacttatcattgaaggaaactcattggaggatgtttcaaagtcagctgcccttattcaacaatctacaacagttaaaaataaggatatccgtaaattcttagatgggctttatgtatctgaaaaaacaactgttgtacaagaagaataacttgtatttttgaaataaatttaagtttatattt

SEQ ID NO: 815 - DNA, 670 bp, Artificial Sequence
  Description of Artificial Sequence:  xx
aaattcttttacggaagacacgttgagaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccrcaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatatt

SEQ ID NO: 816 - DNA, 871 bp, Artificial Sequence
  Description of Artificial Sequence:  xx
gttcgcctgatctgtctttcatatttttaaagtcaagatggctcgaggacctaaaaagcatttgaagcgtttaaacgcacccaaagcatggatgttggacaaattgggaggtgtatttgccccccgtccatccaccggtcctcacaagttgagagaatctttaccattagtaattttcttaagaaacagactaaagtatgccctcaccaacagtgaagtcacaaaaattgttatgcaaagattaattaaagtcgatggaaaagtcagaacagacagtaactatcctgcaggatttatggatgttattactattgagaagactggtgaattcttccgtcttatctatgatgttaaaggtagatttgccattcaccgtattacagctgaagaagcaaaatacaaactctgcaaagtacgaagagtccaaactggaccaaaaggaattccattcttggtgacacatgatggccgtaccatcagataccctgacccaaacatcaaagtcaatgacaccatccaattggaaattgccacatctaaaattttagactacattaagttcgaatctggaaacttatgtatgatcactggaggaagaaatttgggtcgtgtaggtacagttatcaatagggaacgtcatcctggatcctttgatattgtgcatgttaaagatgctaatggtcatgtatttgctactaggttaaataacgttttcattattggtaagggagctaaggccttcgtttccctcccaagaggaaagggagtcaaattgtctattgctgaagagagagacaagaggttagcagccaaaacacattaaatgtaatggttgattacattattttcaataaaacttaaaaaatctgaa

SEQ ID NO: 817 - DNA, 2410 bp, Artificial Sequence
  Description of Artificial Sequence:  xx
cggacgcgtgggggagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaacgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatc

SEQ ID NO: 818 - DNA, 988 bp, Artificial Sequence
  modified_base (884)..(965): n = a, c, g or t/u
  Description of Artificial Sequence: pMON98501 Dv49 dsRNA Expression Cassette
aggacgcgtgggttcgtatttttttcttaacaaaagggcaaaatgagcttttttggaaaattgttcggggggaaaaaggaagagatagcccctagtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgaattagaaaaagaattagaagagctcgaacaagaaggattggaagaagacctgctccaagtgccaggtccaactcaactgccggctgtgcctgctgatgcagttgctactaaaccaatcaaaccagcagctaaaaaagttgaagatgatgacgatatgaaagaattggaagcctgggcctcgtaaaattcctgaaatctggatatttgtaaacgaaatcacccatctaagatgaaaacattataaatatataggtaataacagctaaaaacgtttcaatgtagaacaagcttttgctgaaaaggcgtcttgcaaaaaatgttgataatttagaattctctatatattatatatttgccctttangaaagatttcttttatagtcatagttcaaccanacgtttcataaatagaattacaggggtgtcagaattctacngtgattnattgaaaaaaaaagacttttcct

SEQ ID NO: 819 - DNA, 3001 bp, Artificial Sequence
  Description of Artificial Sequence:    pMON98502 Dv49 dsRNA Expression Cassette
aagcagtggtaacaacgcagagtactttttttttttttttttttttttgacagttcgaaaatggtgatgtgtttataattcgtgtcaatttagtgaaatagcattcaattttttgtataagatctcttcaaaatgccacttcgattagatataaaaagaaagctaacagctcgctcagaccgggtaaaatgtgtggatcttcaccctacagaaccttggatgctgtgttctctttacagcggaaatataaacgtttggaacaccgaaaatcagcaactggttaagacttttgaagtatgtgatgtacctgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcttgtcagcaagttttcgaaggacacactcattatattatgcaaatcgccataaatccaaaagacaacaacacatttgccagtgcatccctagatagaacattgaaagtatggcaattgggagcgtccacagcgaatttcacactagaaggtcatgagaaaggcgttaactgtgtggactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatataccctcagacaattcaacacaatcccaatggccgttttgttgttgtctgtggggatggagaatacataatctacacagcaatggctttaagaaacaaagcgtttggtagcgcacaagaatttgtgtgggctcaagattccagcgaatatgccatcagagaatccggatctactatcagaatttttaagaatttcaaagagaagaagaattttaagtccgattttggagctgaaggtatatacggtggataccttttgggagtcaaatcggtttctggtttgactttctatgattgggaaactctcgatttagtcagaagaatcgagatacaaccaaaagcagtttactggtcagatagtggtaaattagtatgtttggccacagaagatagctactttattctttcttatgattctgatgaagttcaaaaagccagagataacaatcaggttgcggatgatggagtagaatcggctttcaatcttctaggtgaaataaacgaatcagtgcgaactggtctctgggtaggcgactgttttatctacacgaattctgttaatcgtatcaactacttcgttggaggtgaactggttacaattgctcatttggaccggcctttgtatgtcttgggatatgtgcctaaagacgatagattatacctcgtagataaagagttgcgcgtagtaagctaccaattacttctttctgttcttgaatatcaaactgccgtcatgagaagagactttccaacagcagacagagtacttccgtccattcctaaggagcacagaacgagagtggcacatttcttagaaaagcaaggcttcaaacagcaagctttggccgtaagtacagatccagagcacagattcgagctggcagtagcattagaggatcttaatatagccaaaactctagctcaagaagcgaacagtccgcaaaagtggaatcaactagcagaattggcagctgctactaataatgtaagcgtagccaaggaatgtatgcaaaaagcgcaagattatggaggcttgttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatcttaccttcctgataagattacagaagtcgtggaactgtggaagactcagttatcttcagtcaatcaaaaagctggacagagccttgccgatcctaaaaactacgaaaatctgttccctggtttacaagaggcggtggtagctcagaaatttttggaacagcagaataaaggtttagcgcccgcaagagttgccaccaccattcctcctaatcacgacaggaatgttgtagccgaagttcaagcacaatcgaaacccgatgtaccatcatttagttcttcgtttatttcatcagaaatagaagcacaaacaaggagttttgctaaacctgaagaattttcaaacattatacagctggaccaagatgacgacgatatcgatttagatttggacggtgtaaatatcgatgagaacattgacccgacggatatcaacatcgatgatgatttgctgagtgattgaaaataacttttttactttagtattaaatctgtatattcattcctattcttaagaaaatctatatgaattttaatgttttaatagttaagaaatccaaaatttaaaaaaaaaaaaaaaaaaaaaaaaa

SEQ ID NO: 820 - DNA, 2719 bp, Artificial Sequence
  Description of Artificial Sequence:  pMON98503 Dv49 dsRNA Expression Cassette
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgagggcccaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgggagctcgacgtccctcagcagtcgctgtgcgatacccatcgtcatccagatcgtcggtgaatccgacaggattgctaatagcgtttgtgatttcgttggctatgtcgtgttgttcggctatgtcatccatgatatcgtgaacatcatctacattcaaattcttatgagctttcttaagggcatctgcagcatttttcatagaatctaatacagcagtatttgtgctagctccttcgagggcttccctctgcatttcaatagttgtaagggttccatctatttgtagttgggtcttttccaatcgtttcttctttttgagggcttggagtgcaactcttttatttttcgacgcatttttctttgctaccatggtaaattcttctatcttcttttctaaaaaatcctgtttttttattaacatttcttcagtctctctgagtttttgaatagcctccccaggacaagtactgcgatcgcgttaacgctttatcacgataccttctaccacatatcactaacaacatcaacactcatcactctcgacgacatccactcgatcactactctcacacgaccgattaactcctcatccacgcggccgcctgcaggagcgtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgtagatcgccagcggtactcgctgaggcctaggctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattaagcttac

SEQ ID NO: 821 - DNA, 2367 bp, Artificial Sequence
  Description of Artificial Sequence:  pMON98504 Dv49 Concatemer dsRNA Expression Cassette
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgagggcccaccgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgggagctcgacgtccctcagcagtcgctgtgcgataccatatcttcatataattgatcaaaatctgccttgattttagcttcaccatcgtgattttgtccgtttctgccagagatgctttacctaccagctgcacaatattacctaaacatttaacgcgaccagcacgttcgtagaaggaagccaaacgcgaccaatgcggtacgtttcataatagattcagtgtgcccgtcaatttcggttggcaggtaatttttcactgactggccttgcttgacgtacaggccataagtactgcgatcgcgttaacgctttatcacgataccttctaccacatatcactaacaacatcaacactcatcactctcgacgacatccactcgatcactactctcacacgaccgattaactcctcatccacgcggccgcctgcaggagcatggcctgtacgtcaagcaaggccagtcagtgaaaaattacctgccaaccgaaattgacgggcacactgaatctattatgaaacgtaccgcattggtcgcgtttggcttccttctacgaacgtgctggtcgcgttaaatgtttaggtaatattgtgcagctggtaggtaaagcatctctggcagaaacggacaaaatcacgatggtgaagctaaaatcaaggcagattttgatcaattatatgaagatattagatcgccagcggtactcgctgaggcctaggctgcatgcgtttggacgtatgctcattcaggttggagccaatttggttgatgtgtgtgcgagttcttgcgagtctgatgagacatctctgtattgtgtttctttccccagtgttttctgtacttgtgtaatcggctaatcgccaacagattcggcgatgaataaatgagaaataaattgttctgattttgagtgcaaaaaaaaaggaattaagcttac

SEQ ID NO: 822 - DNA, 45 bp, Artificial Sequence
  Description of Artificial Sequence:  Synthetic Primer
ccaagccctcaaaaagaagaaacgattggaaaagacccaactaca

SEQ ID NO: 823 - DNA, 50 bp, Artificial Sequence
  Description of Artificial Sequence:  Synthetic Primer
acgacatagccaacgaaatcacaaacgctattagcaatcctgtcggattc

SEQ ID NO: 824 - DNA, 46 bp, Artificial Sequence
  Description of Artificial Sequence:  Synthetic Primer
tgtgtctgctgatgcagttgctactaaaccaatcaaaccagcagct

SEQ ID NO: 825 - DNA, 113 bp, Artificial Sequence
  Description of Artificial Sequence:  Synthetic Primer
acaccctacacaaccttatatattaacaagtagtgatgatatgcttatcaagctttggaattgggaaaaagcatgggcttgtcagcaagttttcgaaggacacactcattata

SEQ ID NO: 826 - DNA, 153 bp, Artificial Sequence
  Description of Artificial Sequence:  Synthetic Primer
tgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatata

SEQ ID NO: 827 - DNA, 183 bp, Artificial Sequence
  Description of Artificial Sequence:  Synthetic Primer
gttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatc

SEQ ID NO: 828 - DNA, 95 bp, Artificial Sequence
  Description of Artificial Sequence:  Synthetic Primer
ccaagccctcaaaaagaagaaacgattggaaaagacccaactacaacgacatagccaacgaaatcacaaacgctattagcaatcctgtcggattc

SEQ ID NO: 829 - DNA, 96 bp, Artificial Sequence
  Description of Artificial Sequence:  Synthetic Primer
acgacatagccaacgaaatcacaaacgctattagcaatcctgtcggattctgtgtctgctgatgcagttgctactaaaccaatcaaaccagcagct

SEQ ID NO: 830 - DNA, 266 bp, Artificial Sequence
  Description of Artificial Sequence:  Synthetic Primer
acaccctacacaaccttatatattaacaagtagtgatgatatgcttatcaagctttggaattgggaaaaagcatgggcttgtcagcaagttttcgaaggacacactcattatatgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatata

SEQ ID NO: 831 - DNA, 336 bp, Artificial Sequence
  Description of Artificial Sequence:  Synthetic Primer
tgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatatagttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatc

SEQ ID NO: 832 - DNA, 141 bp, Artificial Sequence
  Description of Artificial Sequence:  Synthetic Primer
ccaagccctcaaaaagaagaaacgattggaaaagacccaactacaacgacatagccaacgaaatcacaaacgctattagcaatcctgtcggattctgtgtctgctgatgcagttgctactaaaccaatcaaaccagcagct

SEQ ID NO: 833 - DNA, 449 bp, Artificial Sequence
  Description of Artificial Sequence:  Synthetic Primer
acaccctacacaaccttatatattaacaagtagtgatgatatgcttatcaagctttggaattgggaaaaagcatgggcttgtcagcaagttttcgaaggacacactcattatatgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatatagttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatc

SEQ ID NO: 834 - DNA, 590 bp, Artificial Sequence
  Description of Artificial Sequence:  Synthetic Primer
ccaagccctcaaaaagaagaaacgattggaaaagacccaactacaacgacatagccaacgaaatcacaaacgctattagcaatcctgtcggattctgtgtctgctgatgcagttgctactaaaccaatcaaaccagcagctacaccctacacaaccttatatattaacaagtagtgatgatatgcttatcaagctttggaattgggaaaaagcatgggcttgtcagcaagttttcgaaggacacactcattatatgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatatagttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatc

SEQ ID NO: 835 - DNA, 657 bp, Diabrotica virgifera
gtaaattcaaattacaaaccatattagtcacccgtaaaatgtataaactcaccattattacaaaactttttctttgacttctcaaaaacaaacaatgtggcgcttacaatgtttttcagcggacccattcaattattttaaacttatcacttggatccgatgcacttcatcaatagctaaaaaaattttgctccttgtatctcatcttctagtataagttcacattttctttcattttctagaacccgcaaaactttaataagtacctcttgattcattccaaaaaagattgcatctgaaacatcctctccttgtgtgagttcaaataatgtaaccactgtattttgcatacccctttcacaaatagaatcatatacaatgctagcccattcctcttgggtatgccaatagatttcccaccggtttttgtttttatctacaggagatgcatggccacttttttgcaattcgcttagtatagagattataacgttttgttctaattttctgtttattgatgaattattaaataaaggtgactggtttgtgtctcttacatctagggtgtaagttttggtttgttcgcaaaagtttaaaattaatgacttccatgcatctacttgctttgctcttgtttcaggatgtggctgcaacgtg

SEQ ID NO: 836 - DNA, 1251 bp, Diabrotica virgifera
catatctctccaaactatggcgcgttcggattcatttttcagacggacaaaccggccttttggcgacatctttgcattaaagctctgagcatgaactgtttcctggacaaggttcgcacttgtctcaaaaacacctctaaatcgatgactccacatctcaatgcctctcccatgtaataaatagtgtcttctaaggcagcttcttcagcgaatgcattcaataattgtttatataaaggagctgtcgttgttaccgcatcatctacatctatagattcttgattacttattcgttctatggccttatttagttcttgttctttgtcttgtagcattgtaatatttttgtctagatcattcttttctttttctaatcggctcaatataccgtccaacttcaattttccttgcttcaactcctcctgtgtcctcttgagcgtctctagttcagcttgattctgctggaattgttccttcattcttctaagcagcttctcttccaaagctgtcatcagagattccctgatatgttcttcttttatagtacctgttccggcctgaggtccaggggggaaattaaatggatactgcggttgcgaagaagggtagggtggatatccttggaaagaattgttgctggttggaggatatggagggtacccgccgaaacctcctgatgctggtgggtagggggtaggatacggaggcatgtaaccaccagatggttgaggcatgaatgaatttgacggatacgattcattgtctttggccctagcaaacactggaggttgttcgccaaatgtaacaatcataacttggattaatcctagcaaatctgattcattcggcacccaatcgtgcaaatatggcagataaacttttccattttgatctacaaacatggaaacttttatggacatgtcggaagtcggtttaacatagcaaatgggagcattctctggatgtgtgtcaattaaccatatacaaattggaatattataaatattgcctttgtaacgcacaggaattgtaccagttaagttaatgagatccattcttgtgccatcgttgaaggtgtagacactctgttctggatgtaaacctctgtattgtgtggtgatgttgattatttctctataagctacatcaggattgtgataagcagttagccaagtcctaagtctctccgtatctaccattttctacgaattaatttcttgccagctaaaactatcgagatctagagttctc

SEQ ID NO: 837 - DNA, 669 bp, Diabrotica virgifera
gtcagcagaaaatcgccctgagctgtatgaggaagtcaagctatatcacaatgccagggaaagagagaagtacgataatttagcagatttgtatgctgtaataaacactttgcaacaattagagaaggcatatattcgagattgtgtagtggcaaaggaatatacaggagcttgtagtaaattattagttcagtataaggctgcgtttcgacaagtcaagagtgatgaatttcctacaccagacgcctttgttaagaagtacaggcttgactgtcctgcagctttagaacgtatcaaggaagataggccaatcactatcaaagacgacaaaggcaacactagtcgatgcattgctgatatcgtatcgctattcatcactataatggacaaactgcggttggacattcgttcgatggataacttacatcctgacgtgagggacttagtagatactatgaacagacttagcattctgccatcggatttcgatggaaaggtaaaagtggctgaatggttaaatactttaaatgaaatgcaggcctctgatgaattatccgaagctcaagtgaggcaactgttgtttgatcttgaaagtgcgtatgcgtcctttaataaagtccttcataattctgcctaaatgtacgagatagttgttatgattgttacacg

SEQ ID NO: 838 - DNA, 793 bp, Diabrotica virgifera
gatggtagggtgacgagcagtgtgactcatttttaattttatattgtcaaatatttaggtgttttgctggttattattattatattatttaaaaatggagtggttatttggaaaaaaagtaacccccgaagaaatgcttcgtaaaaaccaacgagcattaaataaagccatgagagatttagatagagaaaagcaaaagatggaacagcaggagaaaaaagtaataaacgatattaaaaaattagccaaggaaggtcaaatggacgctgtcaaaataatggctaaagatctggtcagaactagaaggtatgtgaagaaattcatgttgatgaaggctaacattcaagcagtatcattgaaaattcagactcttagatcccaaaatacaatggcacaagctatgaaaggtgtcactaaagctatgcaaagtatgaataggcagctaaatttaccacagatacaaaggatattacaagaatttgaaaagcagtctgaaattatggatatgaaggaagaagttatgaatgatgccattgatgatgcgatggaaggagatgatgatgaggaggaaactgacgcagttgtcaatcaagttttagatgaattgggtcttcaattgaatgatactctttctggactgcctcaaaccgctggatctcttcctgcctctgggcaaaaacatcctgcagctgcagctgctgttgcaggaggaggtaatggtggcactggtactggaggcagtggtggaaacagtggcggcggaggtggcctttctgatgccgatgcggatttg

SEQ ID NO: 839 - DNA, 767 bp, Diabrotica virgifera
gctacctcctcttcatcctctgattcttcctcattgacttccactttaggttcttctgaaggcacggaaggcatctcttgctcaatcataccagccaattcttcttctacagctgcttcatcttcatctgtcaattgaccactaagaagttcgttaatctcattctgtttgtcaaccccttctcttgtttcatccaatatacgttcaatatcttcaattttgagggaatcattaatttgtttcaaagcttcgttgcctgcttttagaccactcactacttgagtttctaactgggcgaactctatatcactagccattttatcgagattatcaagttgtacatctagcttggacaacagctgttcttgatacctcttcttcttaagtaaaagttttgctctgtctctttggccattgttaagtaacttcttagctatatctttatctttaccaagtgagagctcaattcttttttggtattgtctcaatttatctctttgctgtttgagctgtaacactgctttatcgtgttctgttactctggagggaggcttttttttactaaaaaagatacccattttattactttagtaaaatataaaatttctcttgatttgtgttattcaaaaaattgataccatccttatattatagttttcctattatcacacgttttatgctgttttcttatatcttttaggactaatttttaatcagggttgccagatgaaatttcagaatatccctagacgggagcttcaatttcc

SEQ ID NO: 840 - DNA, 588 bp, Diabrotica virgifera
ctgcttcaaagaaggaccacatgactaccctagaatttgtgctttcattgatgcttctatgaattctgtctctaacctgcatatattcttgttcttgttttacaccagacaatgaatttgtaagttctctgatcatttcctccaacttattagcattttcaccttcttgttgttctgcctttggagattccccaacagccatattaaacataacaactttaggtgtcatagttgacatcttgtttgagaaacaatatgtatatataccagatgtgtgggctgcaaatgtgtattttccggcagtttccctttcaccctggtataagttctggccgtttggatctataatacgcacatctatgtcaaggaatcctccttctgctatttcaaaagtgagacccatttttgtgccagcttccactttgtcaaagaaacattcttctgcatgtgcatctactgtgataaaataggccaaactttgatttatgcccaaacaaaccagtgaaataaggaagccgaaaagatacatgtttactttaaattaaaattagaaaacttcggccacgtaacctctcacacttgacgttc

SEQ ID NO: 841 - DNA, 1098 bp, Diabrotica virgifera
cctgtactttcctgtatcctcatgttcactgtctaccgttttactcacttcctttgttaatactaataccatttcttctatgttccgtgaagagactaattcaagggctagacttaaagtcttcttgcggacttctaagtcaggagcagagagtactctcagtatgtccataactaaatcctgcagaattctttcgtgattaggaagctccttaagtgctatcagcctgtccaaaacgatgagttttacattgttgtcactttctttgataattaactcaatgtaacagctagcagcagctttaacggcagtcggggcactggagagggtgactaaagttcctgcagcttcgtacctgacagcaggactgcttgagttcaacaagttatatatacatctaataaatctagatctttccgcaggattggaatgacacaccttatatatcaactcaacgatgaccagttgtagaatatctccaaatgaatttacttgatctaaacatgatgccaaatacgacaacgccctttcttggtcagcatgaagaagcattaaaaacgcatttcttttacaagacatgtcttgctcaccatccaaataattggagatcagttcaggagcatctggaatgagggcttcaaaatttttgtaaatggtaaaaattgccagtacagcattcctcctcacatagctgtgcctatgatccaaacaagctctaatactgggcattaatggttccaacaattctggttccttcagtttgcacaagaagcgaagtgtagaacctctcaaaaattcatttgggtgttgcagatcttttctataggcatcacataccaaaatcatctcttgtagtagtttaccttctggatttgtttttggaactatttcccagaaaatcaataatagtttttttgccaaatgatcttgtagaggtaaaacgtttcttataatggtcattaggaatccattcggcaacctttctcctgccagaatcatgtgaattattttttctaatgctcttatttttactttaacctcacccttttctaaatccatttttagttgcatttcattgtagggctccgaatctgttgg

SEQ ID NO: 842 - DNA, 718 bp, Diabrotica virgifera
ccttgttcttgattggaactgggttttgtttcatttgcagaacgatggaacgcattcgagaaacgtctttgctgccttgttttgctttaggattgaaatcacacaattttgctattctttcccattcggttcccggttctagttcgtcatcttcggctacgaactgcttttcagcgttcctattagcagcttttgtcttggctatagcttcttcgtgattcttgtaccaatcttctaattctttctttgctacttccctcaattcttgcttctttttctcttcttcctgatctttttcctccaacctcttgatttgctcttccctccataacctgatcttttctggttctactctatcttcttgtcttattgtaagtggggacactctttccctgtattctttatctggatcaaaatcggctgggatatcattaaactttggctcttccaaaaaaccatctggaccattgttttctaccatttcaaaactgctcgcagaattggttgggtcatcaccattaagaactggagcaataactgcggccggtttcacttcatcttcaaggcctgctagttcgtcttgctcgcgtgccaagaattctgccgctgggtcttcgtcggcaactccaaaattgtctccaaatccagacattcttgattttgttaatcttaaggataagaaaagctgctattttcccactgacactgacagcaaagc

SEQ ID NO: 843 - DNA, 842 bp, Diabrotica virgifera
caatcaagctggaatggtagaaactgaaggggaatattgctggcaaatcctgtgaaaatcattttcttttatcttcagatcacgaatgtatggatgatcaggatttgcatccttcaactgagacagatatctattagcaatctcaggtgctttggccatatgtctctgaagagtgatcatgttaacaagtgtatcaggatagttggcatccttatcaagtgcttcttgaagagctgcttcggcttcctcatatttggcttggccaatgaaagtcactgcttgtccgtttagcaacaatggagtggatccatatttgtctacaagttcttggtaaatatagtaggcgtcctggagtttatctccaccagtggatacattaatccaagcttgagccagttgtgttaaagttgcatcatcgtccttatcttgcatctctttcagcttcttccttgccaaatctactctatccaatttcaaaagtatatctataataaaggccattgcttcgaggctttctgtagcgtgcaaaactttatacgcagcatcaagattgccttcgttaacataaatagtagctgctaccaaaattagagtatcattgttagcatttgcttggacttgttgctccacttgagccaccacagaatccttcttgattttgcctgctaagtagtcagcgaggtatttcaggggttggatttctgggggagatgccccgtggatttcgtctaatactactaggaatttattttgggccatataggaccggtaggtgtagaagtctctttggactgctacttcgggcgttgacggctttctgagtttttgtgcctcgtttatgc

SEQ ID NO: 844 - DNA, 679 bp, Diabrotica virgifera
cttctgcaaaagatttggcatacgagatcatgtgcaggtatatcaggaaaaagtcagatcctctttgctatagtctacactacaagataccttgacttagtgacgtcatatgtatctatgtacaatactgttatgaaatttgtatttttggccacatcgtatgcaactatttatttaatctacatgaaatttaaagccacttatgaccataaccatgacacgttcagaatagagtttctcattttaccatcgtttggtttggctatgcttatcaatcacgagttttcatttatggaggtcttgtggactttcagtatttatttggaatcagtggctatattgccgcaattgttcatggtcagtaaaacaggagaagcagaaagtattacttcgcactacttattcgcattgggatcttatagggccctatacattttgaactggatctaccgctatgcaactgaaactcattacgatctcatcgctatagtagctggtgttgtgcagactatattatattgtgacttcttttatctttacattactaaagtactcaagggaaagaaactacaattgcccgcttaaacccctcttatataagacttaactgtacaaacattttactttcagctaaacggtattaacacaatgatgcctaatgatcatgtgtttggatagc

SEQ ID NO: 845 - DNA, 725 bp, Diabrotica virgifera
atgtataagagggatcgggccagaaagctgcagataatgcggcagcggcagttggcggcgcaaacgttgaggggcggattagggcccgatatgtattccggacaaccgggcacttcgcctttcgccaacatccacatcaaacaagaaatacaaatacctcaagtgtcctcccttacctcatcgccagattcgtcgcccagtcccatagcagtagctttaggccaggtgaactcctcgttggtgcagcccacgtccaatcagcagcccgctctccagatcgtcggcgttcctggaggtcactcgtcgatggtcatgggcccggataacaaactctgggcccaagcgaactccaccaccacatcaccccttagtcccaaagtgttccaattcgagactgtcgtaccgggcagcagtgtaccgccttcgagtaaagtgtcgccgctcattagggatttcgttgccgccgttgacgatcgcgaatggcaaaactctttgtacactcttttacaaaaccagacgtacaatcagtgtgaagtggacttatttgaactaatgtgtaaagttttggaccaaaatctcttttctcaagtcgattgggcgaggaattcgatattctttaaagatctcaaggtggacgatcaaatgaaacttctgcagcattcatggtcggatatgttggtgctggatcacatacaccagcgcacgcacaataacctacccgacga

SEQ ID NO: 846 - DNA, 864 bp, Diabrotica virgifera
gcgtgggcgtggcttataatgctagtataggaggtgtacgtatgttagatggtgtagtaaacgacgcagttgaagccagagccctaggtctaaacccggaacacatcgacatctacagcgcttcctggggacctgaagacgacgggaaaaccgtagacggtcccggaccattagcaagacgagcttttatatacggagtaactagtgggagaaaaggaaaaggatctattttcgtttgggcttcgggaaatggaggccgacatacggattcctgcaattgtgatggatacaccaacagtatctttaccttgagtatatctagtgctacacaaggaggttacaaaccttggtatttggaagagtgttcttcaacattagcaacaacttacagctcaggaacacctggacatgacaaaagcgtcgcgactgttgatatggacgctagattacgaccagatcatatctgtactgtagaacatactggaacttcagcttcagcacctttagctgctggaatatgcgccctagctcttgaagccaaccccacgttgacgtggcgtgacatgcaatatttagtagtactaacttcaagagctcctccactggaaaaagaggctggatggatagtaaacggcgttgggcgaaaagcttctcataaatttggttatggtctcatggacgctggtgctttggttactttagctgaaaaatggactacggtaccacctcaacacatctgtaaaagtcaggaaattgtagaagatcgaccaattaatcctgcctatggttccagtttgaatttcaatatggaagtagacgcatgtagtggtaccttgaacgaagtcaggtacctggagcacgtgc

SEQ ID NO: 847 - DNA, 140 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaac

SEQ ID NO: 848 - DNA, 210 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaagg

SEQ ID NO: 849 - DNA, 280 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaag

SEQ ID NO: 850 - DNA, 350 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacc

SEQ ID NO: 851 - DNA, 420 bp, Diabrotica virgifera
catcacgactatcctactagtggagaagtatgcgaagtcgatgtcagagattgggaagaatgcaacagggctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtcc

SEQ ID NO: 852 - DNA, 140 bp, Diabrotica virgifera
ctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaagg

SEQ ID NO: 853 - DNA, 210 bp, Diabrotica virgifera
ctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaag

SEQ ID NO: 854 - DNA, 280 bp, Diabrotica virgifera
ctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacc

SEQ ID NO: 855 - DNA, 350 bp, Diabrotica virgifera
ctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtcc

SEQ ID NO: 856 - DNA, 420 bp, Diabrotica virgifera
ctccaagtgccaggtccaactcaactgccggctgtgtctgctgatgcagttgctactaaaccaatcaaacgatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 857 - DNA, 140 bp, Diabrotica virgifera
gatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaag

SEQ ID NO: 858 - DNA, 210 bp, Diabrotica virgifera
gatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacc

SEQ ID NO: 859 - DNA, 280 bp, Diabrotica virgifera
gatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtcc

SEQ ID NO: 860 - DNA, 350 bp, Diabrotica virgifera
gatgaggaacagacagaacaaaccgcaactgaaacggcaactacagaggtacagaaaaagggtgtcaaggggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 861 - DNA, 140 bp, Diabrotica virgifera
ggtgagatggaacgagattgtcaaatttcacacggtgctgcacaattcttaagagagaggctgtttgaagtctcttcagcaatagacaatttgactccctttcctcttgggagggaaacgaaggccttagctcccttacc

SEQ ID NO: 862 - DNA, 210 bp, Diabrotica virgifera
ggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtcc

SEQ ID NO: 863 - DNA, 280 bp, Diabrotica virgifera
ggtgagatggaacgagattgtcaaatttcacacggtgctgcacaattcttaagagagaggctgtttgaagtctcttcagcaatagacaatttgactccctttcctcttgggagggaaacgaaggccttagctcccttacctcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 864 - DNA, 140 bp, Diabrotica virgifera
tctcttcagcaatagacaatttgactccctttcctcttgggagggaaacgaaggccttagctcccttacctcatcgtccgtttggattcacaaaaacacatcgacttctctctgaaatcacctttgggaggcggtcgtcc

SEQ ID NO: 865 - DNA, 210 bp, Diabrotica virgifera
tctcttcagcaatagacaatttgactccctttcctcttgggagggaaacgaaggccttagctcccttacctcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 866 - DNA, 140 bp, Diabrotica virgifera
tcatcgtccgtttggattcacaaaaacacatcgacttctctctgaaatcacctttgggaggcggtcgtccgatccttttcgatttgttgctgccattggggatccatctggacttctggaggaagcaaggcaggtgcagc

SEQ ID NO: 867 - DNA, 70 bp, Diabrotica virgifera
catcacgactatcctactagtggagaagtatgcgaagtcgatgtcagagattgggaagaatgcaacaggg

SEQ ID NO: 868 - DNA, 70 bp, Diabrotica virgifera
ctccaagtgccaggtccaactcaactgccggctgtgtctgctgatgcagttgctactaaaccaatcaaac

SEQ ID NO: 869 - DNA, 70 bp, Diabrotica virgifera
gatgaggaacagacagaacaaaccgcaactgaaacggcaactacagaggtacagaaaaagggtgtcaagg

SEQ ID NO: 870 - DNA, 70 bp, Diabrotica virgifera
ggtgagatggaacgagattgtcaaatttcacacggtgctgcacaattcttaagagagaggctgtttgaag

SEQ ID NO: 871 - DNA, 70 bp, Diabrotica virgifera
tctcttcagcaatagacaatttgactccctttcctcttgggagggaaacgaaggccttagctcccttacc

SEQ ID NO: 872 - DNA, 70 bp, Diabrotica virgifera
tcatcgtccgtttggattcacaaaaacacatcgacttctctctgaaatcacctttgggaggcggtcgtcc

SEQ ID NO: 873 - DNA, 70 bp, Diabrotica virgifera
gatccttttcgatttgttgctgccattggggatccatctggacttctggaggaagcaaggcaggtgcagc

SEQ ID NO: 874 - DNA, 1358 bp, Diabrotica virgifera
cttgttgaattggaggaggtggcttcaaaaattttgcatttggatctacatctggaaaacctttcttttctccaatttgttccttcagctgttcagcttcatctaccattccgtgagtagcagctgtcaagtaggccaaagaaagttgattggaagccttcaaaattttaacacgctcttcaagatcaccaagcaaaagtgcagcatgatattgagatgatttagcttttctaatttccgcaattttcatcatttttctcaatttgtccaggttgccggtaatcagatataggaatgataatttttcgaaactcttggtcctttgataacacatctcaactacttgatggtttccttgccatagagcagcatgtgctagttgatcccaacaagctttgtcattcaaagatttcgcagcatctagagcaatctcaatatttccacattccagagccaaagtaaatcgagttttgtcgtcttttacaaaatgtaaggctacttcaggataacctttttgttgtaagtaagaaatcatagattgtcccaccaattttgaatttctaaccatatacaaaacttcttcatatttgtgattaattaatgcaagtttgaatttgtattccattgaatccactgtcaatacccgtggtttgcattcacgatcaaggcaaaagatctggtttcctcttactctggtgatgtatattggaagatcgagggttctaataattccttggtcaccgtttttaagtgtatatttcaaaatggttgcttgtagtataaataaaaactcctgtatcatcccaagctccagatttcactctagtattttcgtgtaaacaacataaaacatccaatttcctattacaaatagtcacgttgtgtttggaaaggagagccaagtgggacatatcagacgaccagacaacgtatctgcatttgttaattttcacttgtgctaaagttctcttctgttgaacgtcaaacagagtaacatgttcagaatctcttaataacagcattccagtaccagcataaaatacttcatcacatgtaggagtttgtaccttcttggtgacttcgtttttcaagttcttgataattagttgatgagtcctgtccaaaacggcaaatctgtttcttgcaacccataatgccgtaagtccagaagaccttttgctttcagcttctggtacttgatcatctctctcctgctcttttggaatcacatataaatcgtatgtgctattatccaagtttgaagttcttgtagaaagaagaacagcattttcagctggattaaaggacatcttataaactggtatttttcctccaccacgaatctgaatgactggaac

SEQ ID NO: 875 - DNA, 2714 bp, Diabrotica barberi
atgccacttcgattagatataaaaagaaagctaacagctcgctcagaccgggtaaaatgtgtggatcttcaccctacagaaccttggatgctatgttctctttacagcggaaatataaacgtttggaacaccgaaaatcagcaactggttaagacttttgaagtatgtgatgtacccgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcctgtcagcaagttttcgaaggacacactcactatattatgcaaatcgccataaatccaaaagacaacaacacatttgccagtgcatccctagacagaacattgaaagtatggcaattgggagcgtccacagccaatttcacactagaaggtcacgagaaaggcgttaactgtgtggactattatcatggtggagataagccttatttaatctcaggtgctgatgatagattagtaaaaatctgggattatcaaaacaaaacttgtgttcaaactttagaaggacatgctcaaaatgtaactgctgcatgtttccatccagaacttcctgtagctcttactggaagtgaagatggtactgtcagagtgtggcatgccaacacccatagattagaaagtagcttaaattatggttttgaaagagtgtggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagacatgggtgcttgcgagatataccctcagacaattcaacacaatcccaatggccgttttgtcgttgtctgtggagatggagaatacataatctacacagcaatggctttaagaaacaaagcctttggtagtgcacaagaattcgtgtgggctcaagattccagcgaatatgccatcagagaatccggatctactatcagaatttttaagaatttcaaagagaagaagaattttaagtccgactttggagctgaaggtatatacggtggataccttttgggagtcaaatcagtttctggtttgactttctacgattgggaaactcttgatttagtaagaagaatcgagatacaaccaaaagcagtttactggtcagatagtggtaaattagtatgtttggctacagaagatagctactttattctttcttatgattccgatgaagttcaaaaagccagagataacaatcaggttgcggatgatggagtagaatcggctttcaatcttctaggtgaaataaacgaatcagtgcgaactggtctctgggtaggcgactgttttatttacacgaattctgttaatcgtatcaactacttcgttggaggtgaactggttacaattgcccatttggatcggcctttatatgtcttgggatatgtgcctaaagacgatagattatacctcgtagataaagagttgcgcgtagtaagctaccaattacttctctccgttcttgaataccaaactgccgtcatgagaagagactttccaacagccgatagagtacttccgtccattcctaaggagcacagaacgagagtcgcacatttcttagaaaagcaaggcttcaaacagcaagctttggccgtaagtacagatccagagcacagattcgagctggcagtagcattagaggatcttaacacagccaaaattctagctcaagaagcaaacagtcctcaaaagtggaatcaactagcagaattggctgccgctactaataatgtaagcttagccaaggaatgtatgcaaaaagcgcaagattatggaggcttattgcttcttgctactagttcaggggatgaaaatttagtccgtactctaggagaaacgacacaagcagaaagcaaacataacttagcatttttatcacacttgttagtaggtgatttaaacaaatgtctagacattcttattaataccggtagattgccagaagctgcatttttcgccaggtcttaccttcctgataagattacggaagtcgtagaactttggaagactcagttgtcttcagtcaatcaaaaagctggacagagccttgccgatcctaaaaactacgaaaatctgttccctggtttacaagaggcggtggtagctcagaaatttttggaacagcagaataaaggtttagcacctgcgagaattgccaccaccattcctcctaatcacgacaggaatgttgtagcagaagttcaagcacaatcgaaactcgacataccatcatttagttcttcatttatttcatcagaaatagaagcacaaacaaggagttctgctaaacctgaagagtcttcaaacattatacagctggaccaagatgacgacgatatcgatttagatttggacggtgtaaatatcgatgaaaacattgacacgacggatatcaa

SEQ ID NO: 876 - DNA, 2669 bp, Diabrotica balteata
taacagctcgctcagaccgggtaaaatgtgtggatcttcaccctacagaaccttggatgctatgttccctgtacagtggaaatatcaatgtttggaataccgaaaatcaacaactggttaaaacttttgaagtatgtgatgtacctgtacgaacagctaagtttttacccagaaagaactggatagtcagtggatctgatgatatgcagattcgagttttcaattacaataccttagatcgggtacattcttttgaagctcattcagattatgtgagatgtattgtcgttcatcctacacaaccttatatattaacaagtagtgatgatatgcttatcaagctttggaattgggaaaaagcatgggcttgtcagcaagtttttgaaggacacactcattatattatgcaaatcgccataaatccaaaagacaacaacacatttgccagtgcatctttagatagaacattgaaagtatggcagttgggagcatcaacagcgaatttcacactagaaggtcacgagaaaggtgtaaactgtgtggattattatcatggtggagataagccttatttaatctcaggtgctgatgatagattagtaaaaatctgggattatcaaaataaaacttgtgttcaaactttggaaggacatgctcaaaatgtaacggctgcttgtttccatccagaacttcctgtagcccttactggaagtgaggatggtactgtcagagtgtggcatgccaacacccatagattagagagtagcttaaattatggttttgaaagagtatggactattttctgcctaaagggatcaaataatgtggcattgggttatgatgaaggtagcattttggttaaagttggtagagaagaaccagctgttagtatggatgccagtggaggtaaaattatttgggctagacactctgaacttcaacaggcaaatctcaaggcattagctgaaggtgcagaaataagagacggagaacgccttccagtttctgtaaaagatatgggagcttgcgagatataccctcagacaattcaacacaatcctaacggccgttttgtcgttgtatgtggggatggagaatacataatctacacagcaatggctttaagaaacaaagcttttggtagtgcacaagaatttgtgtgggctcaagattccagcgaatatgccatcagagaatccggatccacaatcagaatttttaagaatttcaaagagaagaagaattttaagtccgactttggagctgaaggtatatatggtggttaccttttgggagtcaaatctgtttctggtttgactttctatgattgggaaactctcgatttggtaagaagaatcgagatacagccaaaagcagtttactggtcggatagtggcaaactagtatgtttggctacagaagacagctactttattctttcttatgattccgatgaagttcaaaaagccagagataacaatcaggttgccgatgatggagtagaatcagctttcaatcttctaggtgaaataaacgaatcagttcgaactggtctgtgggtaggcgactgttttatctacacaaattctgttaatcgtatcaactattttgttggaggtgaactagttacaattgcccatttggatcggcctttgtatgtcttaggatatgtgcccaaagatgatagattatacctggtagataaagagttgcgcgtagtaagctaccaattacttctctctgttcttgaatatcaaaccgctgtcatgagaagagactttccaacagcagatagagtacttccgtctattcctaaggagcacagaacgagagtcgcacatttcttagaaaagcaaggcttcaaacaacaagctttggccgtaagtacagatccagagcacagattcgagctggcagtagcattagaggatcttaacacagccaagattctagctcaagaagcaaacagtccgcaaaagtggaatcaactagcagaattggctgccgctactaataacgtaagcctagccaaggaatgtatgcagaaagcgcaagattatggcggcttattacttcttgctacaagttccggggatgaaagtttagtccgtactctaggagaaacgacacaagcagaaagcaaacataacttagcatttttgtcacacttgttagtaggtgatttaaacaaatgcctagacattcttattaataccggtagattaccagaagctgcatttttcgccagatcttatcttcctgataagataacggaagtggtagaactttggaagactcagttatcttcagtcaatcaaaaagccggacagagccttgccgatccgaaaaattacgaaaatctgttccctggtttacaagaggcagtggtagctcagaaatttttggaacagcagaataaaggtttagcacccgcgcgaattgccaccaccattcctcctaatcatgacaggaatgttgtagccgaagttcaagcacaatcgaaacatgatggaccatcatttagttcgaggagtatttcatcagaaatagaagcacaaacaaggagttctgctaaacctgaagaatcttcaaacattatacagctggatcaagatgacgacgatatcgatttagatttggacggtgtaaatatcgatgagaacattgac

SEQ ID NO: 877 - DNA, 2701 bp, Diabrotica undecimpunctata howardii
atgccacttcgattagatataaaaagaaagctaacagctcgctcagaccgggtaaaatgtgtggatcttcaccctacagaaccttggatgctatgttctctttacagtggaaatatcaacgtttggaataccgaaaatcaacaactggttaaaacttttgaagtatgtgatgtacctgtacggacagctaagtttttgcccaggaagaactggatagtcagtggatctgatgatatgcagattcgagttttcaattacaataccttagatcgggtacattcttttgaagctcattcagattatgtgagatgtattgtcgtacatcctacacaaccttatatattaacaagtagtgatgatatgcttatcaagctttggaattgggaaaaagcatgggcttgtcagcaagtttttgaaggacacactcattatattatgcaaatcgccataaatccgaaagacaacaacacatttgccagtgcatctttagatagaacattgaaagtatggcagttgggagcatcaacagctaatttcacactagaaggtcacgagaaaggtgttaactgtgtggattattatcatggtggagacaagccttatttaatctcaggtgctgatgatagattagtaaaaatctgggattatcaaaataaaacttgtgttcaaactttggaaggacatgctcaaaatgtaacagctgcatgtttccatccggaacttcctgtagcccttactggaagtgaggatggcactgtcagagtgtggcatgccaacactcatagattagagagtagcttaaattatggttttgaaagagtatggaccattttctgcctaaagggatcaaataatgtggcattgggttatgatgaaggtagcattttggttaaagttggtagagaagaaccagctgttagtatggatgccagtggaggtaaaattatttgggctagacactctgaacttcaacaggcaaatctcaaggcattagctgaaggtgcagaaataagagatggagaacgccttccagtttctgtaaaagatatgggagcttgcgagatataccctcagacaattcaacacaatcctaacggccgttttgtcgttgtctgtggagatggagaatacataatctacacagcaatggctttaagaaacaaagcgtttggtagtgcacaagaatttgtgtgggctcaagattccagcgaatatgctatcagagaatccggatctactatcagaatttttaagaatttcaaagagaagaagaatttcaagtccgactttggagctgaaggtatatatggtggttaccttttgggagtcaaatctgtttctggtttgactttctatgattgggaaactctcgatttggtaagaagaatcgagatacaaccaaaagcagtttactggtccgatagtggcaaactagtatgtttggctacagaagacagctactttattctttcttatgattccgatgaagttcaaaaagccagagataacaatcaggttgctgatgatggagtagaatcggctttcaatcttctaggtgaaataaacgaatcagttcgaactggtctgtgggtaggcgactgttttatctacacgaattctgttaatcgtatcaactattttgttggaggtgaactagttacaattgcccatttggatcggcctttgtatgtcttaggatatgtgcctaaagatgatagattatacctggtagataaagagttgcgcgtagtaagctaccaattactcctctctgttcttgaatatcaaactgccgtcatgagaagagactttccaacagcagatagagtacttccgtctattcctaaggagcacagaacgagagtcgcacatttcttagaaaagcaaggcttcaaacagcaagctttggccgtaagtacagatccagagcacagattcgagttggcagtagcattagaggatcttaacacagccaagattctagctcaagaagcaaacagtccgcaaaagtggaatcaactagcagaattggctgccgctactaataacgtaagcctagccaaggaatgtatgcagaaagcgcaagattatggtggcttattgcttcttgctacgagttccggagatgaaagtttagtccgtactctaggagaaacgacacaagcagaaagcaaacataacttagcatttttgtcacacttgttagtaggtgatttaaacaaatgtctagacatccttattaataccggtagattgccagaagctgcatttttcgccagatcttatcttcctgataagataacggaagtcgtagaactttggaagactcagttatcttcagtcaatcaaaaagctggacagagccttgccgatccgaaaaattacgaaaatctgttccctggtttacaagaggcagtggtagcccagaaatttttggaacagcagaataaaggtttagcacccgcgcgaattgccaccactattcctcctaatcacgacaggaatgttgtagccgaagttcaagcacaatcgaaacatgatggaccatcatttagttcgaggagtctttcatcagaaatagaagcacaaacaaggagttctgctaaacctgaagaatcttcaaacattatccagttggatcaagatgatgacgatatcgatttagatttggacggtgtaaatatcgatgagaacattgacc

SEQ ID NO: 878 - DNA, 2714 bp, Diabrotica virgifera zeae
atgccacttcgattagatataaaaagaaagctaacagctcgctcagaccgggtaaaatgtgtggatcttcaccctacagaaccttggatgctatgttctctttacagcggaaatataaacgtttggaacaccgaaaatcagcaactggttaagacttttgaagtatgtgatgtacctgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcttgtcagcaagttttcgaaggacacactcattatattatgcaaattgccataaatccaaaagacaacaacacatttgccagtgcatccctagatagaacattgaaagtatggcaattgggagcgtccacagcgaatttcacactagaaggtcatgagaaaggcgttaactgtgtggactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatataccctcagacaattcaacacaatcccaatggccgttttgttgttgtctgtggggatggagaatacataatctacacagcaatggctttaagaaacaaagcgtttggtagcgcacaagaatttgtgtgggctcaagattccagcgaatatgccatcagagaatccggatctactatcagaatttttaagaatttcaaagagaagaagaattttaagcccgattttggagctgaaggtatatatggtggataccttttgggagtcaaatcggtttctggtttgactttctatgattgggaaactcttgatttagtcagaagaatcgagatacaaccaaaagcagtttactggtcagatagtggtaaattagtatgtttggccacagaagatagctactttattctttcttatgattctgatgaagttcaaaaagccagagataacaatcaggttgcggatgatggagtagaatcggctttcaatcttctaggtgaaataaacgaatcagtgcgaactggtctctgggtaggcgactgttttatctacacgaattctgttaatcgtatcaactacttcgttggaggtgaactggttacaattgctcatttggaccggcctttgtatgtcttgggatatgtgcctaaagacgatagattatacctcgtagataaagagttgcgcgtagtaagctaccaattacttctttctgttcttgaatatcaaactgccgtcatgagaagagactttccaacagcagacagagtacttccgtccattcctaaggagcacagaacgagagtggcacatttcttagaaaagcaaggcttcaaacagcaagctttggccgtaagtacagatccagagcacagattcgagctggcagtagcattagaggatcttaatatagccaaaactctagctcaagaagcgaacagtccgcaaaagtggaatcaactagcagaattggcagctgctactaataatgtaagcttagccaaggaatgtatgcaaaaagcgcaagattatggaggcttgttgcttcttgctacgagctccggtgatgaaaatttagtccgtgctctaggagaaacgacacaagctgaaagcaaacataacttagcatttttgtcacacttgttagtaggtgatttaaacaaatgtctagacattcttattaataccggtagattgccagaagctgcatttttcgccagatcttaccttcctgataagattacagaagtcgtggaactgtggaagactcagttatcttcagtcaatcaaaaagctggacagagccttgccgatcctaaaaactacgaaaatctgttccctggtttacaagaggcggtggtagctcagaaatttttggaacagcagaataaaggtttagcgcccgcaagagttgccaccaccattcctcctaatcacgacaggaatgttgtagccgaagttcaagcacaatcgaaacacgatgtaccatcatttagttcttcgtttatttcatcagaaatagaagcacaaacaaggagttctgctaaacctgaagaatcttcaaacattatacagctggaccaagatgacgacgatatcgatttagatttggacggtgtaaatatcgatgagaacattgacacgacggatatcaa

SEQ ID NO: 879 - DNA, 2714 bp, Diabrotica virgifera virgifera
atgccacttcgattagatataaaaagaaagctaacagctcgctcagaccgggtaaaatgtgtggatcttcaccctacagaaccttggatgctgtgttctctttacagcggaaatataaacgtttggaacaccgaaaatcagcaactggttaagacttttgaagtatgtgatgtacctgttcggacagctaagtttttgcccaggaagaactggatagtcagtgggtctgatgatatgcagattcgagttttcaattacaataccttagatcgggtacattcttttgaggctcattcggattatgtgagatgtattgtcgtacaccctacacaaccttatatattaacaagtagtgatgatatgcttatcaagctttggaattgggaaaaagcatgggcttgtcagcaagttttcgaaggacacactcattatattatgcaaatcgccataaatccaaaagacaacaacacatttgccagtgcatccctagatagaacattgaaagtatggcaattgggagcgtccacagcgaatttcacactagaaggtcatgagaaaggcgttaactgtgtggactattatcacggtggagataaaccttatttaatctcaggcgctgatgatagattagtaaaaatctgggattatcaaaacaaaacttgtgttcaaactttggaaggacatgctcaaaatgtaaccgctgcatgtttccatccagaacttcctgtagctcttactggaagtgaagatggtactgtcagagtgtggcatgccaacacccataggttagaaagtagcttaaattatggctttgaaagagtatggactattttctgcctaaagggatccaataacgtggcattgggttatgatgaaggtagcattttggttaaagttggtagagaagaaccagctgttagtatggatgccagtggaggcaaaattatttgggccagacactctgaacttcaacaggcaaatctcaaggcgttagctgaaggtgcggaaataagagatggagaacgccttccagtttctgtaaaagatatgggtgcttgcgagatataccctcagacaattcaacacaatcccaatggccgttttgttgttgtctgtggggatggagaatacataatctacacagcaatggctttaagaaacaaagcgtttggtagcgcacaagaatttgtgtgggctcaagattccagcgaatatgccatcagagaatccggatctactatcagaatttttaagaatttcaaagagaagaagaattttaagtccgattttggagctgaaggtatatacggtggataccttttgggagtcaaatcggtttctggtttgactttctatgattgggaaactctcgatttagtcagaagaatcgagatacaaccaaaagcagtttactggtcagatagtggtaaattagtatgtttggccacagaagatagctactttattctttcttatgattctgatgaagttcaaaaagccagagataacaatcaggttgcggatgatggagtagaatcggctttcaatcttctaggtgaaataaacgaatcagtgcgaactggtctctgggtaggcgactgttttatctacacgaattctgttaatcgtatcaactacttcgttggaggtgaactggttacaattgctcatttggaccggcctttgtatgtcttgggatatgtgcctaaagacgatagattatacctcgtagataaagagttgcgcgtagtaagctaccaattacttctttctgttcttgaatatcaaactgccgtcatgagaagagactttccaacagcagacagagtacttccgtccattcctaaggagcacagaacgagagtggcacatttcttagaaaagcaaggcttcaaacagcaagctttggccgtaagtacagatccagagcacagattcgagctggcagtagcattagaggatcttaatatagccaaaactctagctcaagaagcgaacagtccgcaaaagtggaatcaactagcagaattggcagctgctactaataatgtaagcgtagccaaggaatgtatgcaaaaagcgcaagattatggaggcttgttgcttcttgctacgagctccggtgatgaaaatttagtccgtactctaggagaaacgacacaagctgaaagcaaacataacttagcatttttgtcacacttgttagtaggtgatttaaacaaatgtctagacattcttattaataccggtagattgccagaagctgcatttttcgccagatcttaccttcctgataagattacagaagtcgtggaactgtggaagactcagttatcttcagtcaatcaaaaagctggacagagccttgccgatcctaaaaactacgaaaatctgttccctggtttacaagaggcggtggtagctcagaaatttttggaacagcagaataaaggtttagcgcccgcaagagttgccaccaccattcctcctaatcacgacaggaatgttgtagccgaagttcaagcacaatcgaaacacgatgtaccatcatttagttcttcgtttatttcatcagaaatagaagcacaaacaaggagttctgctaaacctgaagaatcttcaaacattatacagctggaccaagatgacgacgatatcgatttagatttggacggtgtaaatatcgatgagaacattgacacgacggatatcaa

SEQ ID NO: 880 - DNA, 669 bp, Epilachna varivestis
cgagggccacacccaytatgttatgcaaattgccataaatcctaaggataataatacttttgctagtgcatcattagatagaacactcaaagtttggcagttaggtgcttccacagcaaattttactttagaaggtcacgataaaggagtaaactgcgttgattattatcatggtggagataaaccttatcttatatctggagctgatgatcgattggtaaaaatatgggattatcaaaacaagacatgtgttcaaactttagaaggtcatgcccaaaatgtaactgcagtttgcttccatccagaattgccagtagttttaacaggtagtgaagatggaactgttaggatttggcatgccaatactcataggctggaaagcagtttgaattatggattcgagagagtatgggccatttcttgcttaaaggggtccaacaatgtggttctgggttatgatgaaggtagtgtcctagttaaagttggtcgtgaagaaccagctgtcagtatggatgctagtggtggaaaaattatttgggcccgccattccgaattgcaacaggctaatttgaaggcgcttcctgaaggggcggaggttagagatggcgaacgtttacctgttgctgttaaagacatgggcgcttgygaaatttacccccagaccatcgc

SEQ ID NO: 881 - DNA, 1033 bp, Leptinotarsa decemlineata
ccatggtggcgataaaccatacttgatatcgggagcagacgatcggttggttaaaatctgggactatcaaaacaaaacgtgtgtccaaaccttggaaggacacgcccaaaacgtaaccgcggtttgtttccaccctgaactacctgtggctctcacaggcagcgaagatggtaccgttagagtttggcatacgaatacacacagattagagaattgtttgaattatgggttcgagagagtgtggaccatttgttgcttgaagggttcgaataatgtttctctggggtatgacgagggcagtatattagtgaaagttggaagagaagaaccggcagttagtatggatgccagtggcggtaaaataatttgggcaaggcactcggaattacaacaagctaatttgaaggcgctgccagaaggtggagaaataagagatggggagcgtttacctgtctctgtaaaagatatgggagcatgtgaaatataccctcaaacaatccaacataatccgaatggaagattcgttgtagtatgcggagacggcgaatatatcatttacacagcgatggctctacggaacaaggcttttggaagcgctcaagagtttgtctgggctcaggactccagcgagtatgccattcgcgagtctggttccacaattcggatattcaaaaacttcaaagaaaggaagaacttcaagtcggatttcagcgcggaaggaatctacgggggttttctcttggggattaaatcggtgtccggtttaacgttttacgattgggaaactttggacttggtgagacggattgaaatacaaccgagggcggtttattggtctgacagtggaaaattagtctgtctcgcaacggaggacagctacttcatcctttcttatgattcggagcaagttcagaaggccagggagaacaatcaagtcgcagaggatggcgtagaggccgctttcgatgtgttgggggaaatgaacgagtctgtccgaacaggtctttgggtcggagactgtttcatctatacc

SEQ ID NO: 882 - DNA, 601 bp, Diabrotica balteata
gtcctggggaggctattcaaaaactcagagagactgaagaaatgttaataaaaaaacaggattttttagaaaagaagatagaagaatataccttagtagcaaagaaaaatgcgtcgaaaaataaaagagttgcactccaagctctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaacttgaatgtggatgatgttcacgacatcatggatgacatagccgaacaacacgacatagccaacgaaatcacaaacgctattagcaaccctgttggattcaccgacgatctggacgacgatgaattagagaaagaattagaagagctcgaacaagaaggattggaagaagacctgcttcaagtgccaggtcccactcaactgccggctgtgcctactgatgcagttgctaataaaccaatcaaaccagcagctagaaaagttgaagatgatgacgatatgaaagaattggaagcctg

SEQ ID NO: 883 - DNA, 601 bp, Diabrotica barberi
gtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagactcaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaattacaaatgctattagcaaccctgttggattcaccgacgatctggacgacgatgaattagaaaaagaattagaagagctcgaacaagaaggattggaagaagacctgctccaagtgccaggtccaactcaactgccggctgtgcctgctgatgcagttactactaaaccaatcaaaccagcagctaaaaaagttgaagatgatgacgatatgaaagaattggaagcctg

SEQ ID NO: 884 - DNA, 601 bp, Diabrotica undecimpunctata howardii
gtcctggggaggctattcaaaaactcagagagactgaagaaatgttaataaaaaaacaggattttttagaaaagaagatagaagaatttaccttagtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaacttgaatgtggatgatgttcacgacatcatggatgacatagccgaacaacacgacatagccaacgaaatcacaaacgctattagcaatcctgttggattcaccgacgatctggacgatgatgaattagagaaagaattagaagagctcgaacaagaaggattggaagaagacctgcttcaagtgccaggtccaactcaactgccggctgtgcctactgatgcagttgctaataaaccaattaaaccagcagctagaaaagttgaagatgatgacgatatgaaagaattggaagcctg

SEQ ID NO: 885 - DNA, 601 bp, Diabrotica virgifera zeae
gtcctggggaggctattcaaaaactcagagagactgaagaaatgttaataaaaaaacaggattttttagaaaagaagatagaagaatttaccatggtagcaaagaaaaatgcgtcgaaaaataaaagagttgcactccaagccctcaaaaagaagaaacgattggaaaagacccaactacaaatagatggaacccttacaactattgaaatgcagagggaagccctcgaaggagctagcacaaatactgctgtattagattctatgaaaaatgctgcagatgcccttaagaaagctcataagaatttgaatgtagatgatgttcacgatatcatggatgacatagccgaacaacacgacatagccaacgaaatcacaaacgctattagcaatcctgtcggattcaccgacgatctggatgacgatgaattagaaaaagaattagaagagctcgaacaagaaggattggaagaagacctgctccaagtgccaggtccaactcaactgccggctgtgcctgctgatgcagttgctactaaaccaatcaaaccagcagctaaaaaagttgaagatgatgacgatatgaaagaattggaagcctg

SEQ ID NO: 886 - DNA, 601 bp, Diabrotica virgifera virgifera; identical to SEQ ID NO: 885

SEQ ID NO: 887 - DNA, 145 bp, Artificial Sequence
  Description of Artificial Sequence:  C12 concatemer of highly effective WCR targets, ~50% GC criterion, consisting of segments in order 5'-3' from Dv23-Dv13
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatac

SEQ ID NO: 888 - DNA, 222 bp, Artificial Sequence
  Description of Artificial Sequence:  C12 concatemer of highly effective WCR targets, ~50% GC criterion, consisting of segments in order 5'-3' from 23-Dv13-Dv26
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatacccatacgatttacctgaggaaatgccggataatctgaagcaacatataaggggtatcaacaatactagagagttgag

SEQ ID NO: 889 - DNA, 275 bp, Artificial Sequence
  Description of Artificial Sequence: C12 concatemer of highly effective WCR targets, ~50% GC criterion, consisting of segments in order 5'-3' from Dv23-Dv13-Dv26-Dv18
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagacc

SEQ ID NO: 890 - DNA, 338 bp, Artificial Sequence
  Description of Artificial Sequence: C12 concatemer of highly effective WCR targets, ~50% GC criterion, consisting of segments in order 5'-3' from Dv23-Dv13-Dv26-Dv18-Dv49
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcacc

SEQ ID NO: 891 - DNA, 418 bp, Artificial Sequence
  Description of Artificial Sequence: C12 concatemer of highly effective WCR targets, ~50% GC criterion, consisting of segments in order 5'-3' from Dv23-Dv13-Dv26-Dv18-Dv49-Dv22
cctcaagctgtcattggcatggatattctgtgccaagctaaatccggtatgggaaaaacggctgtttttgcaaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctc

SEQ ID NO: 892 - DNA, 152 bp, Artificial Sequence
  Description of Artificial Sequence: C12 concatemer of highly effective WCR targets, ~50% GC criterion, consisting of segments in order 5'-3' from Dv13-Dv26
caaaggatccaggatgacgttccctattgataactgtacctacacgacccaaatttcttcctccagtgatcatacccatacgatttacctgaggaaatgccggataatctgaagcaacatataaggggtatcaacaatactagagagttgag

SEQ ID NO: 893 - DNA, 205 bp, Artificial Sequence
  Description of Artificial Sequence: C12 concatemer of highly effective WCR targets, ~50% GC criterion, consisting of segments in order 5'-3' from Dv13-Dv26-Dv18
caaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagacc

SEQ ID NO: 894 - DNA, 268 bp, Artificial Sequence
  Description of Artificial Sequence: C12 concatemer of highly effective WCR targets, ~50% GC criterion, consisting of segments in order 5'-3' from Dv13-Dv26-Dv18-Dv49
caaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcacc

SEQ ID NO: 895 - DNA, 348 bp, Artificial Sequence
  Description of Artificial Sequence:  C12 concatemer of highly effective WCR targets, ~50% GC criterion, consisting of segments in order 5'-3' from Dv13-Dv26-Dv18-Dv49-Dv22
caaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctc

SEQ ID NO: 896 - DNA, 408 bp, Artificial Sequence
  Description of Artificial Sequence: C12 concatemer of highly effective WCR targets, ~50% GC criterion, consisting of segments in order 5'-3' from Dv13-Dv26-Dv18-Dv49-Dv22-Dv20
caaaggatccaggatgacgttccctattgataactgtacctacacgacccaaatttcttcctccagtgatcatacccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctccgaagtaatgtacaacggccacactggacgtaagataaatgctcagattttcttaggacc

SEQ ID NO: 897 - DNA, 130 bp, Artificial Sequence
  Description of Artificial Sequence: C12 concatemer of highly effective WCR targets, ~50% GC criterion, consisting of segments in order 5'-3' from Dv26-Dv18
ccatacgatttacctgaggaaatgccggataatctgaagcaacatataaggggtatcaacaatactagagagttgagtcaaacataattatggcacattgtccttggatgtagtatccatcacgcagacc

SEQ ID NO: 898 - DNA, 193 bp, Artificial Sequence
  Description of Artificial Sequence: C12 concatemer of highly effective WCR targets, ~50% GC criterion, consisting of segments in order 5'-3' from Dv26-Dv18-Dv49
ccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcacc

SEQ ID NO: 899 - DNA, 273 bp, Artificial Sequence
  Description of Artificial Sequence: C12 concatemer of highly effective WCR targets, ~50% GC criterion, consisting of segments in order 5'-3' from Dv26-Dv18-Dv49-Dv22
ccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctc

SEQ ID NO: 900 - DNA, 333 bp, Artificial Sequence
  Description of Artificial Sequence: C12 concatemer of highly effective WCR targets, ~50% GC criterion, consisting of segments in order 5'-3' from Dv26-Dv18-Dv49-Dv22-Dv20
ccatacgatttacctgaggaaatgccggataatctgaagcaacatataaggggtatcaacaatactagagagttgagtcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctccgaagtaatgtacaacggccacactggacgtaagataaatgctcagattttcttaggacc

SEQ ID NO: 901 - DNA, 116 bp, Artificial Sequence
  Description of Artificial Sequence: C12 concatemer of highly effective WCR targets, ~50% GC criterion, consisting of segments in order 5'-3' from Dv18-Dv49
tcaaacataattatggcacattgtccttggatgtagtatccatcacgcagaccgccgaacaacacgacatagccaacgaaatcacaaacgctattagcaatcctgtcggattcacc

SEQ ID NO: 902 - DNA, 196 bp, Artificial Sequence
  Description of Artificial Sequence: C12 concatemer of highly effective WCR targets, ~50% GC criterion, consisting of segments in order 5'-3' from Dv18-Dv49-Dv22
tcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctc

SEQ ID NO: 903 - DNA, 256 bp, Artificial Sequence
  Description of Artificial Sequence: C12 concatemer of highly effective WCR targets, ~50% GC criterion, consisting of segments in order 5'-3' from Dv18-Dv49-Dv22-Dv20
tcaaacataattatggcacattgtccttggatgtagtatccatcacgcagaccgccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctccgaagtaatgtacaacggccacactggacgtaagataaatgctcagattttcttaggacc

SEQ ID NO: 904 - DNA, 143 bp, Artificial Sequence
  Description of Artificial Sequence: C12 concatemer of highly effective WCR targets, ~50%  GC criterion, consisting of segments in order 5'-3' from Dv49-Dv22
gccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctc

SEQ ID NO: 905 - DNA, 203 bp, Artificial Sequence
  Description of Artificial Sequence: C12 concatemer of highly effective WCR targets, ~50% GC criterion, consisting of segments in order 5'-3' from Dv49-Dv22-Dv20
gccgaacaacacgacatagccaacgaaatcacaaacgctattagcaatcctgtcggattcaccgtaatgcactcctacgtcgtttggttcgtattggagtactagacgagaacagaatgaagctcgattacgtattgggtctccgaagtaatgtacaacggccacactggacgtaagataaatgctcagattttcttaggacc

SEQ ID NO: 906 - DNA, 140 bp, Artificial Sequence
  Description of Artificial Sequence: C12 concatemer of highly effective WCR targets, ~50% GC criterion, consisting of segments in order 5'-3' from Dv22-Dv20
gtaatgcactcctacgtcgtttggttcgtattggagtactagacgagaacagaatgaagctcgattacgtattgggtctccgaagtaatgtacaacggccacactggacgtaagataaatgctcagattttcttaggacc

What is claimed is:

1. A method for controlling coleopteran pest infestation comprising:
providing in a diet of a coleopteran pest an agent comprising a first polynucleotide sequence and a second polynucleotide sequence wherein said first polynucleotide sequence exhibits from about 95 to about 100% nucleotide sequence identity along at least from about 19 to about 25 contiguous nucleotides to a coding sequence according to SEQ ID NO:818 and is hybridized to said second polynucleotide sequence that is complementary to said first polynucleotide sequence, and;
wherein said agent functions upon ingestion by the pest to inhibit a biological function within said pest thereby controlling pest infestation.

2. The method of claim 1, wherein the first and second polynucleotide sequences are expressed in a plant cell to produce a double stranded ribonucleic acid that functions upon ingestion by the pest to inhibit the expression of a target sequence within said pest.

3. The method of claim 1, wherein the pest exhibits reduced growth following said ingestion.

4. The method of claim 2, wherein the plant cell further comprises a polynucleotide sequence encoding a pesticidal agent selected from the group consisting of a patatin, a *Bacillus thuringiensis* insecticidal protein, a *Xenorhabdus* insecticidal protein, a *Photorhabdus* insecticidal protein, a *Bacillus laterosporus* insecticidal protein, and a *Bacillus sphaericus* insecticidal protein.

5. The method of claim 4 wherein said *Bacillus thuringiensis* insecticidal protein is selected from the group consisting of a Cry1, a Cry3, a TIC851, a CryET70, a Cry22, a TIC901, a TIC201, a TIC407, a TIC417, a binary insecticidal protein CryET33 and CryET34, a binary insecticidal protein CryET80 and CryET76, a binary insecticidal protein TIC100 and TIC101, a combination of an insecticidal protein ET29 or ET37 with an insecticidal protein TIC810 or TIC812, and a binary insecticidal protein PS149B1.

6. The method of claim 1, wherein said coleopteran pest is a *Diabrotica* spp. selected from the group consisting of *Diabrotica virgifera*, *Diabrotica virgifera virgifera*, *Diabrotica virgifera zea*, *Diabrotica balteata*, *Diabrotica barberi*, *Diabrotica viridula*, *Diabrotica speciosa*, and *Diabrotica undecimpunctata*.

7. The method of claim 1, wherein the pest exhibits reduced feeding following said ingestion.

8. The method of claim 2, wherein the plant cell is a corn plant cell.

9. The method of claim 2, wherein the first and second polynucleotide sequences are expressed from a construct integrated in the genome of the plant cell.

10. The method of claim 2, wherein the first and second polynucleotide sequences are expressed as a single polynucleotide molecule.

11. The method of claim 10, wherein the first and second polynucleotide sequences are expressed as a single polynucleotide molecule that forms a stem-loop structure upon expression.

* * * * *

UNITED STATES PATENT AND TRADEMARK OFFICE
CERTIFICATE OF CORRECTION

| | | |
|---|---|---|
| PATENT NO. | : 7,943,819 B2 | Page 1 of 1 |
| APPLICATION NO. | : 11/522307 | |
| DATED | : May 17, 2011 | |
| INVENTOR(S) | : Baum et al. | |

It is certified that error appears in the above-identified patent and that said Letters Patent is hereby corrected as shown below:

On the Title page, item [73] for Assignee, delete "Devgen N.V., Zwijnaarde (BE)".

Signed and Sealed this
Thirteenth Day of November, 2012

David J. Kappos
*Director of the United States Patent and Trademark Office*